US006849714B1

US 6,849,714 B1

(12) United States Patent
Bridon et al.

(10) Patent No.: US 6,849,714 B1
(45) Date of Patent: *Feb. 1, 2005

(54) PROTECTION OF ENDOGENOUS THERAPEUTIC PEPTIDES FROM PEPTIDASE ACTIVITY THROUGH CONJUGATION TO BLOOD COMPONENTS

(75) Inventors: Dominique P. Bridon, Outremont (CA); Alan M. Ezrin, Moraga, CA (US); Peter G. Milner, Los Altos Hills, CA (US); Darren L. Holmes, Montreal (CA); Karen Thibaudeau, Montreal (CA)

(73) Assignee: ConjuChem, Inc., Montreal (CA)

( * ) Notice: Subject to any disclaimer, the term of this patent is extended or adjusted under 35 U.S.C. 154(b) by 0 days.

This patent is subject to a terminal disclaimer.

(21) Appl. No.: 09/623,548

(22) PCT Filed: May 17, 2000

(86) PCT No.: PCT/US00/13576

§ 371 (c)(1),
(2), (4) Date: Sep. 5, 2000

(87) PCT Pub. No.: WO00/69900

PCT Pub. Date: Nov. 23, 2000

Related U.S. Application Data

(60) Provisional application No. 60/134,406, filed on May 17, 1999, provisional application No. 60/153,406, filed on Sep. 10, 1999, and provisional application No. 60/159,783, filed on Oct. 15, 1999.

(51) Int. Cl.$^7$ .............................................. C07K 17/00
(52) U.S. Cl. ............................ 530/335; 530/320; 514/2
(58) Field of Search ................................. 530/335, 320, 530/327, 313; 514/2, 15; 424/184.1

(56) References Cited

U.S. PATENT DOCUMENTS

| 4,462,941 A | | 7/1984 | Lee et al. | |
|---|---|---|---|---|
| 5,493,007 A | | 2/1996 | Burnier et al. | |
| 5,580,853 A | * | 12/1996 | Sytkowski et al. | ............. 514/8 |
| 5,612,034 A | * | 3/1997 | Pouletty et al. | .......... 424/184.1 |
| 5,654,276 A | | 8/1997 | Barrett et al. | |
| 6,329,336 B1 | * | 12/2001 | Bridon et al. | .................. 514/2 |
| 6,500,918 B2 | * | 12/2002 | Ezrin et al. | ................. 530/327 |

FOREIGN PATENT DOCUMENTS

| EP | 0 602 290 | 4/1994 |
|---|---|---|
| WO | 9325217 | 12/1993 |
| WO | 9510302 | 4/1995 |
| WO | 9606626 | 3/1996 |
| WO | 9924075 | 5/1999 |
| WO | 9924462 | 5/1999 |
| WO | 9948536 | 9/1999 |
| WO | 00/76550 | 12/2000 |
| WO | 00/76551 | 12/2000 |

OTHER PUBLICATIONS

C. Knusli et al. Polyethylene glycol (PEG) modification of granulocyte macrophage colony stimulating factor (GM–CSF) enhances neutrophil priming activity but not colony stimulating activity. British Journal of Haematology 1992, 82, 654–663.*
Biotech Report, 1994/1995, 106–107 Patrias, Karen, Pinkus, Anita, McConnell, Harry, Mitchell, Steve.
Proceedings of the 8$^{th}$ American Peptide Symposium, 1983, 409–412 Kenneth Motteson, Nobb RL, Banda PW, Sancles A, Smith AJ.
Int. J. Biochem. Cell. Biol., 1998, 30, 1281–1284 Thim L, Kristensen P, Larsen PJ, Wulff BS.
Endocrinology, 1982, 110 (3), 1049–1051 Reubi JC, Rivier J, Perrin M, Brown M, Vale W.
J. Biol. Chem., 1995, 270 (43), 25344–25347 Kapas S, Catt KJ, Clark AJ.
J. Dev. Physiol., 1989, 12, 55–62 Smith FG, Sato T, Varille VA, Robillard JE.
Anti–Cancer Drugs, 1997, 8, 677–685 Stehle G, Sinn H, Wunder A, Schrenk HH, Schutts, Maier–Borst W, Heene, DL.
Biopolymers (Peptide Science), 1998, 47, 451–463 Oren Z, Shai Y.
Ann. Rev. Neurosci., 1984, 7, 223–255 Akil H, Watson SJ, Young E, Lewis ME, Khachatunan H, Walker JM.
U.S. patent application Ser. No. 09/657,276, Bridon et al.
Chem. Pharm. Bull., 1979, 27 (8), 1942–1944 Hirai Y, Yasuhara T, Yoshida H, Nakajima T, Fujino M, Kitada C.
Proc. Natl. Acad. Sci., 1986, 83, 265–269 Mumby SM, Kahn RA, Manning DR, Gilman AG.
TINS, 1993, 16, 403–409 Selkoe DJ.
U.S. patent application Ser. No. 09/424,571, Ezrin et al., filed Aug. 7, 2003.
U.S. patent application Ser. No. 09/530,891, Blanchard et al., filed Aug. 7, 2003.

* cited by examiner

Primary Examiner—Karen Cochrane Carlson
Assistant Examiner—Anand Desai
(74) Attorney, Agent, or Firm—Morrison & Foerster LLP

(57) ABSTRACT

A method of synthesizing a modified therapeutic peptide capable of forming a peptidase-stabilized therapeutic peptide conjugate, the peptide having between 3 and 50 amino acids, is k. In a first step of the method, a therapeutic peptide having a carboxy terminal amino acid and amino terminal amino acid is synthesized. In a second step, pairs of cysteine residues present in the therapeutic peptide are sequentially and selectively oxidized to form disulfide bridges in the therapeutic peptide. In a third step, a protecting group is attached to remaining cysteine residues that do not form disulfide bridges in the therapeutic peptide. Finally, the peptide is coupled to a reactive group capable of reacting with amino groups, hydroxyl groups or thiol groups on a blood component to form a covalent bond therewith.

13 Claims, No Drawings

PROTECTION OF ENDOGENOUS THERAPEUTIC PEPTIDES FROM PEPTIDASE ACTIVITY THROUGH CONJUGATION TO BLOOD COMPONENTS

This application claims benefit of Provision Appls. 60/134,406 filed May 17, 1999, Provisional No. 60/153,406 filed Sep. 10, 1999 and Provisional No. 60/159,783 filed Oct. 15, 1999.

FIELD OF THE INVENTION

This invention relates to modified therapeutic peptides. In particular, this invention relates to protection of endogenous therapeutic peptides from peptidase activity through a modification that enables the peptide to selectively conjugate to blood components, thus protecting the peptide from peptidase activity and increasing the duration of action of the therapeutic peptide for the treatment of various disorders.

BACKGROUND OF THE INVENTION

Many endogenous peptides have been described as key components of biological processes. Some of these peptides have been identified as key therapeutic agents for the management of various disorders. In general, endogenous peptides are more desirable as therapeutic agents than synthetic peptides with non-native sequences, because they do not produce an immune response due to their endogenous character. In addition, endogenous peptides are highly specific for their target receptors and are easy to synthesize and manufacture. However, a major difficulty with the delivery of such therapeutic peptides is their short plasma half-life, mainly due to rapid serum clearance and proteolytic degradation via the action of peptidases.

Peptidases break a peptide bond in peptides by inserting a water molecule across the bond. Generally, most peptides are broken down by peptidases in the body in a manner of a few minutes or less. In addition, some peptidases are specific for certain types of peptides, making their degradation even more rapid. Thus, if a peptide is used as a therapeutic agent, its activity is generally reduced as the peptide quickly degrades in the body due to the action of peptidases.

One way to overcome this disadvantage is to administer large dosages of the therapeutic peptide of interest to the patient so that even if some of the peptide is degraded, enough remains to be therapeutically effective. However, this method is quite uncomfortable for the patient. Since most therapeutic peptides cannot be administered orally, the therapeutic peptide would have to be either constantly infused, frequently administered by intravenous injections, or administered frequently by the inconvenient route of subcutaneous injections. The need for frequent administration also results in many potential peptide therapeutics having an unacceptably high projected cost per treatment course. The presence of large amounts of degraded peptide may also generate undesired side effects.

Discomfort in administration and high costs are two reasons why most therapeutic peptides with attractive bioactivity profiles are not developed as drug candidates. Instead, these therapeutic peptides are used as templates for the development of peptidomimetic compounds to substitute for the therapeutic peptide. Biotechnology and large pharmaceutical firms frequently undertake lengthy and expensive optimization programs to attempt to develop non-peptide, organic compounds which mimic the activity seen with therapeutic peptides without incurring an unacceptable side effect profile. For example, cyclic peptides, peptidomimetics and small molecules coming from expensive SAR (Structure Activity Relationship) and molecular modeling studies have led to the development of an incredible amount of peptide mimics. However, these peptide mimics in no way reflect the exact original biological nature of the therapeutic peptide, and thus are inferior to the endogenous therapeutic peptide as therapeutic agents.

An alternative to creating peptide mimics is to block the action of peptidases to prevent degradation of the therapeutic peptide or to modify the therapeutic peptides in such a way that their degradation is slowed down while still maintaining biological activity. Such methods include conjugation with polymeric materials such as dextrans, polyvinyl pyrrolidones, glycopeptides, polyethylene glycol and polyamino acids, conjugation with adroitin sulfates, as well as conjugation with polysaccharides, low molecular weight compounds such as aminolethicin, fatty acids, vitamin $B_{12}$, and glycosides. These conjugates, however, are still often susceptible to protease activity. In addition, the therapeutic activity of these peptides is often reduced by the addition of the polymeric material. Finally, there is the risk of the conjugates generating an immune response when the material is injected in vivo. Several methods include ex vivo conjugation with carrier proteins, resulting in the production of randomized conjugates. Since conjugates are difficult to manufacture, and their interest is limited by commercial availability of the carriers, as well as by their poor pharmaco economics.

There is thus a need for novel methods to modify therapeutic peptides to protect them from peptidase activity and to provide longer duration of action in vivo, while maintaining low toxicity yet retaining the therapeutic advantages of the modified peptides.

SUMMARY OF THE INVENTION

This invention is directed to overcoming the problem of peptide degradation in the body by modifying the therapeutic peptide of interest and attaching it to protein carriers, such that the action of peptidases is prevented, or slowed down. More specifically, this invention relates to novel chemically reactive derivatives of therapeutic peptides that can react with available functionalities on blood proteins to form covalent linkages, specifically a therapeutic peptide-maleimide derivative. The invention also relates to novel chemically reactive derivatives or analogs of such therapeutic peptides. The invention additionally pertains to the therapeutic uses of such compounds.

The present invention is directed to modifying and attaching therapeutic peptides to protein carriers, preferentially albumin, through in vivo or ex vivo technology to prevent or reduce the action of peptidases by virtue of a synthetic modification on the first residue to be cleaved. Therapeutic peptides are usually active at the N-terminus portion, at the C-terminus portion, or in an interior portion of the peptide chain. Using the technology of this invention, a site other than the active portion of a therapeutic peptide is modified with certain reactive groups. These reactive groups are capable of forming covalent bonds with functionalities present on blood components. The reactive group is placed at a site such that when the therapeutic peptide is bonded to the blood component, the peptide retains a substantial proportion of the parent compound's activity.

The modification of the therapeutic peptide through the chemical modification used in the invention is done in such a way that all or most of the peptide specificity is conserved despite attachment to a blood component. This therapeutic peptide-blood component complex is now capable of traveling to various body regions without and being degraded by peptidases, with the peptide still retaining its therapeutic activity. The invention is applicable to all known therapeutic peptides and is easily tested under physiological conditions by the direct comparison of the pharmacokinetic parameters for the free and the modified therapeutic peptide.

The present invention is directed to a modified therapeutic peptide capable of forming a peptidase stablilized therapeutic peptide composed of between 3 and 50 amino acids. The peptide has a carboxy terminal amino acid, an amino terminal amino acid, a therapeutically active region of amino acids and a less therapeutically active region of amino acids. The peptide comprises a reactive group which reacts with amino groups, hydroxyl groups, or thiol groups on blood components to form a stable covalent bond and thereby forms the peptidase stabilized therapeutic peptide. In the peptide of the invention the reactive group is selected from the group consisting of succinimidyl and maleimido groups and the reactive group is attached to an amino acid positioned in the less therapeutically active region of amino acids.

In one embodiment, the therapeutically active region of the peptide includes the carboxy terminal amino acid and the reactive group is attached to said amino terminal amino acid.

In another embodiment, the therapeutically active region of the peptide includes the amino terminal amino acid and the reactive group is attached to the carboxy terminal amino acid.

In another embodiment, the therapeutically active region of the peptide includes the carboxy terminal amino acid and the reactive group is attached to an amino acid positioned between the amino terminal amino acid and the carboxy terminal amino acid.

In yet another embodiment, the therapeutically active region includes the amino terminal amino acid and the reactive group is attached to an amino acid positioned between the amino terminal amino acid and the carboxy terminal amino acid.

The present invention is also directed to a method of synthesizing the modified therapeutic peptide. The method comprises the following steps. In the first step, if the therapeutic peptide does not contain a cysteine, then the peptide is synthesized from the carboxy terminal amino acid and the reactive group is added to the carboxy terminal amino acid. Alternatively, a terminal lysine is added to the carboxy terminal amino acid and the reactive group is added to the terminal lysine. In the second step, if the therapeutic peptide contains only one cysteine, then the cysteine is reacted with a protective group prior to addition of the reactive group to an amino acid in the less therapeutically active region of the peptide. In the third step, if the therapeutic peptide containe two cysteines as a disulfide bridge, then the two cysteines are oxidized and the reactive group is added to the amino terminal amino acid, or to the carboxy terminal amino acid, or to an amino acid positioned between the carboxy terminal amino acid and the amino terminal amino acid of the therapeutic peptide. In the fourth step, if the therapeutic peptide contains more than two cysteines as disulfide bridges, the cysteines are sequentially oxidized in the disulfide bridges and the peptide is purified prior to the addition of the reactive groups to the carboxy terminal amino acid.

The present invention is also directed to a method for protecting a therapeutic peptide from peptidase activity in vivo, the peptide being composed of between 3 and 50 amino acids and having a carboxy terminus and an amino terminus and a carboxy terminal amino acid amino acid and an amino terminal amino acid. The method comprises the following steps:

(a) modifying the peptide by attaching a reactive group to the carboxy terminal amino acid, to the amino terminal amino acid, or to an amino acid located between the amino terminal amino acid and the carboxy terminal amino acid, such that the modified peptide is capable of forming a covalent bond in vivo with a reactive functionality on a blood component;

(b) forming a covalent bond between the reactive group and a reactive functionality on a blood component to form a peptide-blood component conjugate, thereby protecting the peptide from peptidase activity; and (c) analyzing the stability of the peptide-blood component conjugate to assess the protection of the peptide from peptidase activity. These steps may be performed either in vivo or ex vivo.

The present invention is also directed to a method for protecting a therapeutic peptide from peptidase activity in vivo, the peptide being composed of between 3 and 50 amino acids and having a therapeutically active region of amino acids and a less therapeutically active region of amino acids. The method comprises the following steps:

(a) determining the therapeutically active region of amino acids;

(b) modifying the peptide at an amino acid included in the less therapeutically active region of amino acids by attaching a reactive group to the amino acid to form a modified peptide, such that the modified peptide has therapeutic activity and is capable of forming a covalent bond in vivo with a reactive functionality on a blood component;

(c) forming a covalent bond between the reactive entity and a reactive functionality on a blood component to form a peptide-blood component conjugate, thereby protecting the peptide from peptidase activity; and (d) analyzing the stability of the peptide-blood component conjugate to assess the protection of the peptide from peptidase activity. These steps may be performed either in vivo or ex vivo.

The peptides useful in the compositions and methods of the present invention include, but are not limited to, the peptides presented in SEQ ID NO:1 to SEQ ID NO:1617.

DETAILED DESCRIPTION OF THE INVENTION

Definitions

To ensure a complete understanding of the invention, the following definitions are provided:

Reactive Groups:

Reactive groups are entities capable of forming a covalent bond. Such reactive groups are coupled or bonded to a therapeutic peptide of interest. Reactive groups will generally be stable in an aqueous environment and will usually be carboxy, phosphoryl, or convenient acyl group, either as an ester or a mixed anhydride, or an imidate, thereby capable of forming a covalent bond with functionalities such as an amino group, a hydroxy or a thiol at the target site on mobile blood components. For the most part, the esters will involve phenolic compounds, or be thiol esters, alkyl esters, phosphate esters, or the like. Reactive groups include succimidyl and maleimido groups.

Functionalities:

Functionalities are groups on blood components, including mobile and fixed proteins, to which reactive groups on modified therapeutic peptides react to form covalent bonds. Functionalities usually include hydroxyl groups for bonding to ester reactive groups, thiol groups for bonding to maleimides, imidates and thioester groups; amino groups for bonding to activated carboxyl, phosphoryl or any other acyl groups on reactive groups.

Blood Components:

Blood components may be either fixed or mobile. Fixed blood components are non-mobile blood components and include tissues, membrane receptors, interstitial proteins, fibrin proteins, collagens, platelets, endothelial cells, epithelial cells and their associated membrane and membraneous receptors, somatic body cells, skeletal and smooth muscle cells, neuronal components, osteocytes and osteoclasts and all body tissues especially those associated with the circulatory and lymphatic systems. Mobile blood components are blood components that do not have a fixed situs for any extended period of time, generally not exceeding 5, more usually one minute. These blood components are not membrane-associated and are present in the blood for extended periods of time and are present in a minimum concentration of at least 0.1 $\mu$g/ml. Mobile blood components include serum albumin, transferrin, ferritin and immunoglobulins such as IgM and IgG. The half-life of mobile blood components is at least about 12 hours.

Protective Groups:

Protective groups are chemical moieties utilized to protect peptide derivatives from reacting with themselves. Various protective groups are disclosed herein and in U.S. Pat. No. 5,493,007 which is hereby incorporated by reference. Such protective groups include acetyl, fluorenylmethyloxycarbonyl (Fmoc), t-butyloxycarbonyl (Boc), benzyloxycarbonyl (Cbz), and the like. The specific protected amino acids are depicted in Table 1.

Linking Groups:

Linking groups are chemical moieties that link or connect reactive groups to therapeutic peptides. Linking groups may comprise one or more alkyl groups, alkoxy group, alkenyl group, alkynyl group or amino group substituted by alkyl groups, cycloalkyl group, polycyclic group, aryl groups, polyaryl groups, substituted aryl groups, heterocyclic groups, and substituted heterocyclic groups. Linking groups may also comprise poly ethoxy aminoacids such as AEA ((2-amino)ethoxy acetic acid) or a preferred linking group AEEA ([2-(2-amino)ethoxy)]ethoxy acetic acid). A preferred linking group is aminoethoxyethoxyacetic acid (AEEA).

Sensitive Functional Groups

A sensitive functional group is a group of atoms that represents a potential reaction site on a therapeutic peptide. If present, a sensitive functional group may be chosen as the attachment point for the linker-reactive group modification. Sensitive functional groups include but are not limited to carboxyl, amino, thiol, and hydroxyl groups.

Modified Therapeutic Peptides

A modified therapeutic peptide peptide is a therapeutic peptide that has been modified by attaching a reactive group, and is capable of forming a peptidase stabilized peptide through conjugation to blood components. The reactive group may be attached to the therapeutic peptide either via a linking group, or optionally without using a linking group. It is also contemplated that one or more additional amino acids may be added to the therapeutic peptide to facilitate the attachment of the reactive group. Modified peptides may be administered in vivo such that conjugation with blood components occurs in vivo, or they may be first conjugated to blood components in vitro and the resulting peptidase stabalized peptide (as defined below) administered in vivo. The terms "modified therapeutic peptide" and "modified peptide" may be used interchangeably in this application.

Peptidase Stabalized Therapeutic Peptides

A peptidase stabalized therapeutic peptide is a modified peptide that has been conjugated to a blood component via a covalent bond formed between the reactive group of the modified peptide and the functionalities of the blood component, with or without a linking group. Peptidase stabalized peptides are more stable in the presence of peptidases in vivo than a non-stabalized peptide. A peptidase stabalized therapeutic peptide generally has an increased half life of at least 10–50% as compared to a non-stabalized peptide of identical sequence. Peptidase stability is determined by comparing the half life of the unmodified therapeutic peptide in serum or blood to the half life of a modified counterpart therapeutic peptide in serum or blood. Half life is determined by sampling the serum or blood after administration of the modified and non-modified peptides and determining the activity of the peptide. In addition to determining the activity, the length of the therapeutic peptide may also be measured.

Therapeutic Peptides

As used in this invention, therapeutic peptides are amino acid chains of between 2–50 amino acids with therapeutic activity, as defined below. Each therapeutic peptide has an amino terminus (also referred to as N-terminus or amino terminal amino acid), a carboxyl terminus (also referred to as C-terminus terminal carboxyl terminal amino acid) and internal amino acids located between the amino terminus and the carboxyl terminus. The amino terminus is defined by the only amino acid in the therapeutic peptide chain with a free $\alpha$-amino group. The carboxyl terminus is defined by the only amino acid in the therapeutic peptide chain with a free $\alpha$-carboxyl group.

Therapeutic peptides used in the present invention contain a therapeutically active region generally located at the amino terminus, at the carboxyl terminus, or at an internal amino acid. The therapeutically active region may be identified using blind or structure activity relationship (SAR) driven substitution, as defined in more detail in this application. SAR is an analysis which defines the relationship between the structure of a molecule and its pharmacological activity for a series of compounds. Alternatively, where the therapeutically active region has previously been defined and is available in the literature, it may be obtained by referring to references such as scientific journals. Knowledge of the location of the therapeutically active region of the peptide is important for modifying the therapeutic peptide, as defined in more detail below.

Therapeutic peptides used in this invention also contain a less therapeutically active region generally located at the amino terminus, at or near the carboxyl terminus, or at or near an internal amino acid. The less therapeutically active region is a region of amino acids that does not coincide with the therapeutically active region of the therapeutic peptide. The less therapeutically active region is generally located away from the therapeutically active region, such that modification at the less therapeutically active region does not substantially affect the therapeutic activity of the therapeutic peptide. For example, if the therapeutically active region is located at the amino terminus, the therapeutic peptide will be modified at either the carboxyl terminus or at an internal amino acid. Alternatively, if the therapeutically active region is located at the carboxyl terminus, the therapeutic peptide will be modified at either the amino terminus or at an internal amino acid. Finally, if the therapeutically active region is located at an internal region, the therapeutic peptide will be modified at either the amino terminus or the carboxyl terminus.

"Therapeutic activity" is any activity directed toward healing or curing a biological disorder in a patient. Examples of said therapeutic peptides include pituitary hormones such as vasopressin, oxytocin, melanocyte stimulating hormones, adrenocorticotropic hormones, growth hormones; hypothalamic hormones such as growth hormone releasing factor, corticotropin releasing factor, prolactin releasing peptides, gonadotropin releasing hormone and its associated peptides, luteinizing hormone release hormones, thyrotropin releasing hormone, orexin, and somatostatin; thyroid hormones such as calcitonins, calcitonin precursors, and calcitonin gene related peptides; parathyroid hormones and their related proteins; pancreatic hormones such as insulin and insulin-like peptides, glucagon, somatostatin, pancreatic polypeptides, amylin, peptide YY, and neuropeptide Y; digestive hormones such as gastrin, gastrin releasing peptides, gastrin inhibitory peptides, cholecystokinin, secretin, motilin, and vasoactive intestinal peptide; natriuretic peptides such as atrial natriuretic peptides, brain natriuretic peptides, and C-type natriuretic peptides; neurokinins such as neurokinin A, neurokinin B, and substance P; renin related peptides such as renin substrates and inhibitors and angiotensins; endothelins, including big endothelin, endothelin A receptor antagonists, and sarafotoxin peptides; and other peptides such as adrenomedullin peptides, allatostatin peptides, amyloid beta protein fragments, antibiotic and antimicrobial peptides, apoptosis related peptides, bag cell peptides, bombesin, bone Gla protein peptides, CART peptides, chemotactic peptides, cortistatin peptides, fibronectin fragments and fibrin related peptides, FMRF and analog peptides, galanin and related peptides, growth factors and related peptides, Gtherapeutic peptide-binding protein fragments, guanylin and uroguanylin, inhibin peptides, interleukin and interleukin receptor proteins, laminin fragments, leptin fragment peptides, leucokinins, mast cell degranulating peptides, pituitary adenylate cyclase activating polypeptides, pancreastatin, peptide T, polypeptides, virus related peptides, signal transduction reagents, toxins, and miscellaneous peptides such as adjuvant peptide analogs, alpha mating factor, antiarrhythmic peptide, antifreeze polypeptide, anorexigenic peptide, bovine pineal antireproductive peptide, bursin, C3 peptide P16, tumor necrosis factor, cadherin peptide, chromogranin A fragment, contraceptive tetrapeptide, conantokin G, conantokin T, crustacean cardioactive peptide, C-telopeptide, cytochrome b588 peptide, decorsin, delicioius peptide, delta-sleep-inducing peptide, diazempam-binding inhibitor fragment, nitric oxide synthase blocking peptide, OVA peptide, platelet calpain inhibitor (P1), plasminogen activator inhibitor 1, rigin, schizophrenia related peptide, serum thymic factor, sodium potassium Atherapeutic peptidease inhibiro-1, speract, sperm activating peptide, systemin, thrombin receptor agonist, thymic humoral gamma2 factor, thymopentin, thymosin alpha 1, thymus factor, tuftsin, adipokinetic hormone, uremic pentapeptide and other therapeutic peptides.

Taking into account these definitions, the focus of this invention is to modify therapeutic peptides to protect them from peptidase activity in vivo and thereby extend the effective therapeutic life of the therapeutic peptide in question as compared to administration of the peptide per se to a patient.

1. Therapeutic Peptides Used in the Present Invention

Peptide fragments chosen from the determined amino acid sequence of a therapeutic peptide as provided in the attached SEQUENCE LISTING constitute the starting point in the development comprising the present invention. The peptides range from 2 to 50 amino acids in length. The interchangeable terms "peptide fragment" and "peptide moiety" are meant to include both synthetic and naturally occurring amino acid sequences derivable from a naturally occurring amino acid sequence.

In one embodiment, peptide and peptide fragments are synthesized by conventional means, either by bench-top methods or by automated peptide synthesis machines as discussed in detail below. However, it is also possible to obtain fragments of the peptides by fragmenting the naturally occurring amino acid sequence, using, for example, a proteolytic enzyme. Further, it is possible to obtain the desired fragments of the therapeutic peptide through the use of recombinant DNA technology, as disclosed by Maniatis, T., et al., Molecular Biology: A Laboratory Manual, Cold Spring Harbor, N.Y. (1982), which is hereby incorporated by reference. The use of other new modifications to existing methodologies is also contemplated.

The present invention includes peptides which are derivable from the naturally occuring sequence of the therapeutic peptide. A peptide is said to be "derivable from a naturally occurring amino acid sequence" if it can be obtained by fragmenting a naturally occurring sequence, or if it can be synthesized based upon a knowledge of the sequence of the naturally occurring amino acid sequence or of the genetic material (DNA or RNA) which encodes this sequence. Included within the scope of the present invention are those molecules which are said to be "derivatives" of a peptide. Such a "derivative" has the following characteristics: (1) it shares substantial homology with the therapeutic peptide or a similarly sized fragment of the peptide and (2) it is capable of functioning with the same therapeutic activity as the peptide.

A derivative of a peptide is said to share "substantial homology" with the peptide if the amino acid sequences of the derivative is at least 80%, and more preferably at least 90%, and most preferably at least 95%, the same as that of either the peptide or a fragment of the peptide having the same number of amino acid residues as the derivative.

The derivatives of the present invention include fragments which, in addition to containing a sequence that is substantially homologous to that of a naturally occurring therapeutic peptide may contain one or more additional amino acids at their amino and/or their carboxy termini as discussed in detail below. Thus, the invention pertains to polypeptide fragments of the therapeutic peptide that may contain one or more amino acids that may not be present in a naturally occurring therapeutic peptide sequence provided that such fragments have a therapeutic activity which exceeds that of the therapeutic peptide.

Similarly, the invention includes polypeptide fragments which, although containing a sequence that is substantially homologous to that of a naturally occurring therapeutic peptide, may lack one or more additional amino acids at their amino and/or their carboxy termini that are naturally found on the therapeutic peptide. Thus, the invention pertains to polypeptide fragments of the therapeutic peptide that may lack one or more amino acids that are normally present in the naturally occurring peptide sequence provided that such polypeptides have a therapeutic activity which exceeds that of the therapeutic peptide.

The invention also encompasses the obvious or trivial variants of the above-described fragments which have inconsequential amino acid substitutions (and thus have amino acid sequences which differ from that of the natural sequence) provided that such variants have an activity which is substantially identical to that of the above-described derivatives. Examples of obvious or trivial substitutions include the substitution of one basic residue for another (i.e. Arg for Lys), the substitution of one hydrophobic residue for another (i.e. Leu for Ile), or the substitution of one aromatic residue for another (i.e. Phe for Tyr), etc.

As is known in the art, the amino acid residues may be in their protected or unprotected form, using appropriate amino or carboxyl protecting groups as discussed in detail below. The variable length peptides may be in the form of the free amines (on the N-terminus), or acid-addition salts thereof. Common acid addition salts are hydrohalic acid salts, i.e., HBr, HI, or, more preferably, HCl. Useful cations are alkali or alkaline earth metallic cations (i.e., Na, K, Li, Ca, Ba, etc.) or amine cations (i.e., tetraalkylammonium, trialkylammonium, where alkyl can be $C_1C_{12}$).

Any peptide having a therapeutic activity may be used in this invention. The following list of peptides provides examples of peptides that may be used in this invention, but is not exhaustive and in no way limits the number or type of peptides that may be used in this invention. These therapeutic peptides and fragments produced from these peptides may be modified according to the present invention, and used therapeutically in the body.

A. Pituitary Hormones (SEQ ID NOS: 1–72)

Adrenocortiocotropic Hormones (ACTH, aka Corticotropin) (SEQ ID NOS: 1–22)

The endocrine functions of the adrenal cortex are regulated by an anterior pituitary hormone, ACTH. ACTH, a 39-amino acid peptide is generated in the corticotrophic cells of the anterior pituitary under the control of corticotropin releasing factor. ACTH is derived by post-translational modification from a 241-amino acid precursor known as pro-opiomelanocortin (POMC).

The biological role of ACTH is to maintain the bulk and the viability of the adrenal cortex and to stimulate the production of adrenal cortex steroids, principally cortisol and costicosterone. The mechanism of action of ACTH involves binding to the ACTH receptor followed by activation of adenylate cyclase, elevation of cyclic AMP (cAMP), and increased protein kinase A (PKA) activity of adrenal cortex tissue. The main effect of these events is to increase the activity of a side chain-cleaving enzyme, which converts cholesterol to pregnenolone. Because of the distribution of enzymes in the various adrenal cortex subdivisions, the principal physiological effect of ACTH is production of the glucocorticosteroids.

Aside from its function controlling adrenal cortical activity, ACTH appears to have diverse biological roles including modulation of endocrine and exocrine glands, temperature regulation and influences on nerve regeneration and development. In addition, ACTH and its fragments affect motivation, learning, and behavior. The use of ACTH as a therapeutic agent may thus help the control of these functions. ACTH release from the anterior pituitary is mediated by corticotropin releasing factor (CRF).

Growth Hormone Peptides (SEQ ID NOS: 23–24, 45)

Human placental lactogen (hPL), growth hormones, and prolactin (Prl) comprise the growth hormone family. All have about 200 amino acids, 2 disulfide bonds, and no glycosylation. Although each has special receptors and unique characteristics to their activity, they all possess growth-promoting and lactogenic activity. Mature GH (22,000 daltons) is synthesized in acidophilic pituitary somatotropes as a single polypeptide chain. Because of alternate RNA splicing, a small amount of a somewhat smaller molecular form is also secreted.

There are a number of genetic deficiencies associated with GH. GH-deficient dwarfs lack the ability to synthesize or secrete GH, and these short-statured individuals respond well to GH therapy. Pygmies lack the IGF-1 response to GH but not its metabolic effects; thus in pygmies the deficiency is post-receptor in nature. Finally, Laron dwarfs have normal or excess plasma GH, but lack liver GH receptors and have low levels of circulating IGF-1. The defect in these individuals is clearly related to an inability to respond to GH by the production of IGF-1. The production of excessive amounts of GH before epiphyseal closure of the long bones leads to gigantism, and when GH becomes excessive after epiphyseal closure, acral bone growth leads to the characteristic features of acromegaly. Using GH as a therapeutic agent would aid in treating these disorders, and potentially stimulate growth in other cases of short stature with low or normal GH levels.

Melanocyte Stimulating Hormones (MSH) (SEQ ID NOS: 25–39)

Melanocyte stimulating hormone (MSH) is generated in the intermediary pituitary under the control of dopamine. MSH may have important physiological roles in the control of vertebrate pigment cell melanogenesis, neural functioning related to learning and behavior, and fetal development. See Sawyer, T. K. et al., Proc. Nat. Acad. Sci USA, 79, 1751 (1982).

Oxytocin (SEQ ID NOS: 40–44)

Oxytocin is involved in the enhancement of lactation, contraction of the uterus, and relaxation of the pelvis prior to childbirth. Oxytocin secretion in nursing women is stimulated by direct neural feedback obtained by stimulation of the nipple during suckling. Its physiological effects include the contraction of mammary gland myoepithelial cells, which induces the ejection of milk from mammary glands, and the stimulation of uterine smooth muscle contraction leading to childbirth. Oxytocin causes myoepithelial cells surrounding secretory acini of mammary glands to contract, pushing milk through ducts. In addition, it stimulates the release of prolactin, and prolactin is trophic on the breast and stimulates acinar formation of milk. A conjugated oxytocin could thus be used to aid lactation and help relax the pelvis prior to birth. It could also be used to prevent post partum uterine hemorrage.

Vasopressin (ADH) (SEQ ID NOS: 46–72)

Vasopressin is also known as antidiuretic hormone (ADH), because it is the main regulator of body fluid osmolarity, causing antidiuresis and increase in blood pressure. Vasopressin binds plasma membrane receptors and acts through G-proteins to activate the cyclic AMP/protein kinase A (cAMP/PKA) regulatory system. The secretion of vasopressin is regulated in the hypothalamus by osmoreceptors, which sense water concentration and stimulate increased vasopressin secretion when plasma osmolarity increases. The secreted vasopressin increases the reabsorption rate of water in kidney tubule cells, causing the excretion of urine that is concentrated in $Na^+$ and thus yielding a net drop in osmolarity of body fluids. Vasopressin deficiency leads to watery urine and polydipsia, a condition known as diabetes insipidus. Using conjugated vasopressin or vasopressin fragments would thus prevent these disorders and allow the regular maintenance of the body's osmolarity.

B. Hypothalamic Hormones (Releasing Factors)

Corticotropin Releasing Factor (CRF) & Related Peptides (SEQ ID NOS: 73–102)

Corticotrophin-releasing factor (CRF), a 41 amino acid peptide, plays a significant role in coordinating the overall response to stress through actions both in the brain and the periphery. In the brain, CRF is produced and secreted primarily from parvocellular neurons of the paraventricular hypothalamic nucleus. From there, the CRF-containing neurons project to the portal capillary zone of the median eminence and act to stimulate the secretion of adrenocorticotrophic hormone (ACTH), beta-endorphin, and other proopiomelanocortin (POMC)-derived peptides from the pituitary gland. The subsequent ACTH-induced release of adrenal glucocorticoids represents the final stage in the hypothalamic-pituitary-adrenal axis (HPA), which mediates the endocrine response to stress. Besides its neuroendocrine role, CRF also functions as a neurotransmitter and neuromodulator to elicit a wide spectrum of autonomic, behavioral and immune effects to physiological, pharmacological, and pathological stimuli.

Clinical studies indicated that CRF hypersecretion is associated with various diseases, such as major depression, anxiety-related illness, eating disorder, as well as inflammatory disorder. Low levels of CRF have been found in Alzheimer's disease, dementias, obesity, and many endocrine diseases. Therefore, the use of CRF as a therapeutic agent to counter the effects associated with high levels or low levels of CRF will provide a basis for the treatment of diseases that are associated with abnormal CRF levels. Several peptide antagonists and nonpeptide antagonists have been discovered and widely studied, including a-helical CRF(9–41), Astressin, D-PheCRF(12–41) (peptide antagonist) and CP-154526 (nonpeptide antagonist). These CRF antagonists may provide a novel agent for treatment of depression, anxiety and other CRF related illnesses. Conjugated CRF peptides could thus be used to maintain adrenal health and viability during long term steroid use or as anti-inflamatory agents.

Gonadotropin Releasing Hormone Associated Peptides (GAP) (SEQ ID NOS: 103–110)

GAP is contained in the precursor molecule to gonadotropin-releasing hormone (GnRH). GAP has prolactin inhibiting properties. Gn-RH is a hormone secreted by the hypothalamus that stimulate the release of gonadotrophic hormones follicle stimulating hormone (FSH) and luteinizing hormone (LH). Low levels of circulating sex hormone reduce feedback inhibition on GnRH synthesis, leading to elevated levels of FSH and LH. The latter peptide hormones bind to gonadal tissue, resulting in sex hormone production via cyclic AMP (cAMP) and protein kinase A (PKA) mediated pathways. A conjugated GnRM could be used to aid fertility, or as a contraceptive in either males or females. This agent would have use in animals as well as humans.

Growth Hormone Releasing Factor (GRF) (SEQ ID NOS: 111–134)

GRF is a hypothalamic peptide that plays a critical role in controlling the synthesis and secretion of growth hormone in the anterior pituitary. Some structurally unrelated short peptides have also been reported to elicit growth hormone secretion by a different mechanism.

Under the influence of GRF, growth hormone is released into the systemic circulation, causing the target tissue to secrete IGF-1. Growth hormone also has other more direct metabolic effects; it is both hyperglycemic and lipolytic. The principal source of systemic IGF-1 is the liver, although most other tissues secrete and contribute to systemic IGF-1. Liver IGF-1 is considered to be the principal regulator of tissue growth. In particular, the IGF-1 secreted by the liver is believed to synchronize growth throughout the body, resulting in a homeostatic balance of tissue size and mass. IGF-1 secreted by peripheral tissues is generally considered to be autocrine or paracrine in its biological action. The use of a conjugated GRF as a therapeutic agent to increase GH release, would then help treat disorders involving growth functions regulated by GRF.

Lutenizing Hormone Release Hormones (LH-RH) (SEQ ID NOS: 135–161)

Luteinizing hormone releasing hormone is the key mediator in the neuroregulation of the secretion of gonadotropins, luteinizing hormone (LH) and follicle stimulating hormone (FSH). LH-RH can modify sexual behavior by regulating plasma gonadotropin and sex steroid levels. See Vale, W. W. et al., Peptides, Structure and Biological Function, Proceedings of the Sixth American Peptide Symposium, Gross, E. and Meienhofer, M., eds., 781 (1979). A conjugated LH-RH agent could be used to stimulate ovulation in humans or animals as an aid to fertility.

Orexins (SEQ ID NOS: 162–164)

Orexins are a family of neuropeptides from the hypothalamus that have been recently discovered and characterized. Orexins stimulate appetite and food consumption. Their genes are expressed bilaterally and symmetrically in the lateral hypothalamus, which was earlier determined to be the "feeding center" of the hypothalamus. In contrast, the so-called satiety center is expressed in the ventromedial hypothalamus and is dominated by the leptin-regulated neuropeptide network.

Prolactin Releasing Peptides (SEQ ID NOS: 65–170)

Prolactin is produced by acidophilic pituitary lactotropes. Prolactin releasing peptides act on lactotrope to release prolactin. PRL initiates and maintains lactation in mammals, but normally only in mammary tissue that has been primed with estrogenic sex hormones. A conjugated PRP could be used to increase lactation in humans or animals.

Somatostatin (SEQ ID NOS: 171–201)

Also known as Growth Hormone Release Inhibiting Factors (GIF), somatostatin is a 14 amino acid peptide is secreted by both the hypothatamus and by d cells of the pancreas (its pancreatic version is discussed below). Somatostatin has been reported to modulate physiological functions at various sites including pituitary, pancreas, gut and brain. It inhibits the release of growth hormone, insulin, and glucagon. It has many biological roles, including: inhibition of basal and stimulated hormone secretion from endocrine and exocrine cells, an effect on locomotor activity and cognitive function, and possible therapeutic value in small cell lung cancer. See Reubi, J. C. et al, Endocrinology, 110, 1049 (1982). A conjugated somatostatin could be used to treat giantism in children or acromegaly in the adult.

Thyrotropin Releasing Hormone (THR) and Analogs (SEQ ID NOS: 202–214)

THR stimulates the production of thyroid stimulating hormone (TSH, also known as thyrotropin) and prolactin secretion. In adults, TSH is responsible for up-regulating general protein synthesis and inducing a state of positive nitrogen balance. In the embryo, it is necessary for normal development. Hypothyroidism in the embryo is responsible for cretinism, which is characterized by multiple congenital defects and mental retardation. A conjugated THR could then be used as a therapeutic agent in the treatment of these disorders. It could also be used to treat pituitary causes of thyroid insufficiency or in the diagnosis of human tumors of the thyroid.

C. Thyroid Hormones

Calcitonins (CT) & Caltitonins Precursor Peptides (SEQ ID NOS: 215–224)

Calcitonin (CT) is a 32-amino acid peptide secreted by C cells of the thyroid gland. Calcitonin is employed therapeutically to relieve the symptoms of osteoporosis, although details of its mechanism of action remain unclear. However, it has been observed that CT induces the synthesis of parathyroid hormone (PTH) in isolated cells, which leads in vivo to increased plasma $Ca^{2+}$ levels. In addition, CT has been shown to reduce the synthesis of osteoporin (Opn), a protein made by osteoclasts and responsible for attaching osteoclasts to bone. Thus, using conjugated CT as a therapeutic peptide would elevate plasma $Ca^{2+}$ via PTH induction and reduce bone reabsorption by decreasing osteoclast binding to bone.

Calcitonins Gene Related Peptide (CGRP) (SEQ ID NOS: 225–253)

CGRP is a 37 amino acid peptide that results from alternative splicing of calcitonin gene transcripts. It exists in at least two forms: alpha-CGRP (or CGRP-I) and beta-CGRP (or CGRP-II). CGRP has considerable homology with amylin and adrenomedullin, and is widely distributed both centrally and peripherally in organs including the skin, the heart, the pancreas, the lungs, and the kidneys. CGRP has many biological roles, affecting the nervous and cardiovascular systems, inflammation and metabolism.

D. Parathyrold Hormones and Related Proteins

Parathyroid Hormones (PTH) (SEQ ID NOS: 254–293)

Parathyroid hormone (PTH) is synthesized and secreted by chief cells of the parathyroid in response to systemic $Ca^{2+}$ levels. It plays a major role in the modulation of serum calcium concentration and thereby affect the physiology of mineral and bone metabolism. The $Ca^{2+}$ receptor of the parathyroid gland responds to $Ca^{2+}$ by increasing intracellular levels of PKC, $Ca^{2+}$ and $IP_3$; this stage is followed, after a period of protein synthesis, by PTH secretion. The synthesis and secretion of PTH in chief cells is constitutive, but $Ca^{2+}$ regulates the level of PTH in chief cells (and thus its secretion) by increasing the rate of PTH proteolysis when plasma $Ca^{2+}$ levels rise and by decreasing the proteolysis of PTH when $Ca^{2+}$ levels fall. The role of PTH is to regulate $Ca^{2+}$ concentration in extracellular fluids. The feedback loop that regulates PTH secretion therefore involves the parathyroids, $Ca^{2+}$, and the target tissues described below.

PTH acts by binding to cAMP-coupled plasma membrane receptors, initiating a cascade of reactions that culminates in the biological response. The body's response to PTH is complex but is aimed in all tissues at increasing $Ca^{2+}$ levels in extracellular fluids. PTH induces the dissolution of bone by stimulating osteoclast activity, which leads to elevated plasma $Ca^{2+}$ and phosphate. In the kidney, PTH reduces renal $Ca^{2+}$ clearance by stimulating its reabsorption; at the same time, PTH reduces the reabsorption of phosphate and thereby increases its clearance. Finally, PTH acts on the liver, kidney, and intestine to stimulate the production of the steroid hormone 1,25-dihydroxycholecalciferol (calcitriol), which is responsible for $Ca^{2+}$ absorption in the intestine. A conjugated PTH could be used to regulate calcium homeostasis in patients with parathyroid hormone deficiency states. Inhibitor analogues could be used to block PTH action in renal failure or other patients with excessive PTH levels.

Parathyroid Hormone Related Proteins (PTHrP) (SEQ ID NOS: 294–309)

Parathyroid hormone-related protein (PTHrP) has received attention as a physiological regulator attenuating chondrocytic differentiation and preventing apoptotic cell death. PTHrP was initially identified as a tumor-derived, secretory protein with structural similarity to parathyroid hormone (PTH), the major regulator of calcium homeostasis. PTH and PTHrP bind to a common G protein-coupled cell surface receptor (PTH/PTHrP or PTH-1 receptor) that recognizes the N-terminal (1–34) region of these peptides. Hence, when tumor-derived PTHrP enters the circulation, it activates receptors in classic PTH target organs such as bone and kidney and elicits PTH-like bioactivity. By promoting bone resorption and inhibiting calcium excretion, circulating PTHrP gives rise to the common paraneoplastic syndrome of to malignancy-associated humoral hypercalcemia.

Although initially discovered in tumors, PTHrP was subsequently shown to be expressed in a remarkable variety of normal tissues including the fetal and adult skeleton, where acting in concert with its amino terminal PTH-1 receptor, it serves to regulate cellular growth and differentiation. The anabolic effects of intermittent PTH administration on bone and its therapeutic potential in osteoporosis have been extensively explored. With the recognition that PTHrP is the endogenous ligand for the PTH/PTHrP receptor in osteoblasts, its use as an anabolic agent has also been investigated. Modified PTHrP peptides could be used for similar indications as PTH.

E. Pancreatic Hormones

The principal role of the pancreatic hormones is the regulation of whole-body energy metabolism, principally by regulating the concentration and activity of numerous enzymes involved in catabolism and anabolism of the major cell energy supplies.

Amylin (SEQ ID NOS: 310–335)

Pancreatic beta-cell hormone amylin is a 37-amino-acid peptide related to CGRP and calcitonin. It is co-secreted with insulin from pancreatic beta-cells. Amylin is deficient with type 1 diabetes mellitus. Amylin appears to work with insulin to regulate plasma glucose concentrations in the bloodstream, suppressing the postherapeutic peptiderandial secretion of glucagon and restraining the rate of gastric emptying. People with diabetes have a deficiency in the secretion of amylin that parallels the deficiency in insulin secretion, resulting in an excessive inflow of glucose into the bloodstream during the postherapeutic peptiderandial period.

While insulin replacement therapy is a cornerstone of diabetes treatment, replacement of the function of both amylin and insulin may allow a more complete restoration of the normal physiology of glucose control. Type 2 diabetes is characterized by islet amyloid deposits, which are primarily composed of the amyloidogenic human form of islet amyloid polypeptide. A conjugated amylin could be used in the management of diabetes to limit post prandial hyperglysemia.

Glucagon (SEQ ID NOS: 336–3761)

Glucagon is a 29-amino acid hormone synthesized by the a cells of the islets of Langerhans as a very much larger proglucagon molecule. Like insulin, glucagon lacks a plasma carrier protein, and like insulin its circulating half life is also about 5 minutes. As a consequence of the latter trait, the principal effect of glucagon is on the liver, which is the first tissue perfused by blood containing pancreatic secretions. Glucagon binds to plasma membrane receptors and is coupled through G-proteins to adenylate cyclase. The resultant increases in cAMP and PKA reverse all of the effects described above that insulin has on liver. The increases also lead to a marked elevation of circulating glucose, with the glucose being derived from liver gluconeogenesis and liver glycogenolysis. A conjugated glucagon construct could be used to manage brittle diabetes with recurrent hypoglycemia or to prevent or treat iatrogenic hypoglycemia.

Insulin and Insulin-Like Peptides (SEQ ID NOS: 377–382)

The earliest of these hormones recognized was insulin, a disulfide bonded dipeptide of 21 and 30 amino acids produced by the pancreas, whose major function is to counter the concerted action of a number of hyperglycemia-generating hormones and to maintain low blood glucose levels. Insulin is a member of a family of structurally and functionally similar molecules that include IGF-1, IGF-2, and relaxin. The tertiary structure of all 4 molecules is similar, and all have growth-promoting activities, but the dominant role of insulin is metabolic while the dominant roles of the IGFs and relaxin are in the regulation of cell growth and differentiation.

Insulin is synthesized as a preprohormone in the b cells of the islets of Langerhans. Its signal peptide is removed in the cisternae of the endoplasmic reticulum and it is packaged into secretory vesicles in the Golgi, folded to its native structure, and locked in this conformation by the formation of 2 disulfide bonds. Specific protease activity cleaves the center third of the molecule, which dissociates as C peptide, leaving the amino terminal B peptide disulfide bonded to the carboxy terminal A peptide.

Insulin generates its intracellular effects by binding to a plasma membrane receptor, which is the same in all cells. The receptor is a disulfide-bonded glycoprotein. One function of insulin (aside from its role in signal transduction) is to increase glucose transport in extrahepatic tissue is by increasing the number of glucose transport molecules in the plasma membrane. Glucose transporters are in a continuous state of turnover. Increases in the plasma membrane content of transporters stem from an increase in the rate of recruitment of new transporters into the plasma membrane, deriving from a special pool of preformed transporters localized in the cytoplasm.

In addition to its role in regulating glucose metabolism (and its therapeutic use in treating diabetes), insulin stimulates lipogenesis, diminishes lipolysis, and increases amino acid transport into cells. Insulin also modulates transcription, altering the cell content of numerous mRNAs. It stimulates growth, DNA synthesis, and cell replication, effects that it holds in common with the IGFs and relaxin. A conjugated insulin could thus be used to manage diabetes.

NeuroPeptide Y (SEQ ID NOS: 383–389)

Neuropeptide Y (NPY), a peptide with 36 amino acid residues, is one of the most abundant neuropeptides in both the peripheral and the central nervous systems. It belongs to the pancreatic polypeptide family of peptides. Like its relatives, peptide YY (PYY) and pancreatic polypeptide (PP), NPY is bent into hairpin configuration that is important in bringing the free ends of the molecule together for binding to the receptors.

NPY exerts a wide range of effects in the central nervous system (CNS) and the periphery. Its CNS actions include major effects on feeding and energy expenditure, and alterations in heart rate, blood pressure, arousal and mood. In the periphery, NPY causes vasoconstriction and hypertension; it is also found in the gastrointestinal and urogenital tract, implicating its functions by action upon gastrointestinal and renal targets. In recent studies, hypothalamic NPY has been found to play a fundamental role in developing the features of obesity, it is a major transducer in the pathways signalling body fat to the hypothalamus, and in regulating body fat content. Leptin, an obese gene product, has been found to decrease NPY gene expression in obese (ob/ob) mice. Insulin and corticosteroids are also involved in the regulation of hypothalamic NPY synthesis, with insulin decreasing and corticosteroids increasing NPY expression. A conjugated NPY could be used to treat obesity and MODM (Type II DM) in obese patients.

Pancreatic Polypeptides (PP) (SEQ ID NOS: 390–396)

Pancreatic polypeptide (PP) is a 36-amino acid hormone produced by F cells within the pancreatic islets and the exocrine pancreas. It is a member of the PP fold family of regulatory peptides, and increases glycogenolysis and regulates gastrointestinal activity. A conjugated pancreatic polypeptide could thus be used to after absorption and metabolism of foods.

Peptide YY (SEQ ID NOS: 397–400)

PYY is a thirty six amino acid long peptide, first isolated from porcine intestinal tissue and mainly localized in intestinal endocrine cells. It has many biological activities, including a range of activities within the digestive system and potent inhibition of intestinal electrolyte and fluid secretion.

Somatostatin (SEQ ID NOS: 171–201)

The somatostatin secreted by d cells of the pancreas is a 14-amino acid peptide identical to somatostatin secreted by the hypothalamus. In neural tissue somatostatin inhibits GH secretion and thus has systemic effects. In the pancreas, somatostatin acts a paracrine inhibitor of other pancreatic hormones and thus also has systemic effects. It has been speculated that somatostatin secretion responds principally to blood glucose levels, increasing as blood glucose levels rise and thus leading to down-regulation of glucagon secretion. A conjugated somatostatin could then be used to aid in the management of diabetes.

F. Digestive Hormones

Cholecystokinin (CCK) & Related Peptides (SEQ ID NOS: 401–416)

CCK is a polypeptide of 33 amino acids originally isolated from pig small intestine that stimulates gallbladder contraction and bile flow and increases secretion of digestive enzymes from pancreas. It exists in multiple forms, including CCK-4 and CCK-8, with the octapeptide representing the dominant molecular species showing the greatest activity. It belongs to the CCK/gastrin peptide family and is distributed centrally in the nervous system and peripherally in the gastrointestinal system. It has many biological roles, including stimulation of pancreatic secretion, gall bladder contraction and intestinal mobility in the GI tract as well as the possible mediation of satiety and painful stimuli. A conjugated CCK could be used in diagnostic studies of the gall bladder or in chronic cholecystisis.

Gastrin Releasing Peptide (GRP) (SEQ ID NOS: 417–429)

GRP is a 27-amino acid peptide originally isolated from porcine non-antral gastric tissue, and is the homolog of the frog skin peptide named bombesin growth. It is widely distributed both centrally and peripherally in tissues including brain, lung and gastrointestinal tract It regulates a variety of cell physiological processes including secretion, smooth muscle contraction, neurotransmission and cell growth. A conjugated GRP could be used in the treatment of adynamic ileus or constipation in the elderly.

Gastrin & Related Peptides (SEQ ID NOS: 417–429)

Gastrin is a polypeptide of 17 amino acids produced by stomach antrum, which stimulates acid and pepsin secretion. Gastrin also stimulates pancreatic secretions. Multiple active products are generated from the gastrin precursor, and there are multiple control points in gastrin biosynthesis. Biosynthetic precursors and intermediates (progastrin and Gly-gastrins) are putative growth factors; their products, the amidated gastrins, regulate epithelial cell proliferation, the differentiation of acid-producing parietal cells and histamine-secreting enterochromaffin-like (ECL) cells, and the expression of genes associated with histamine synthesis and storage in ECL cells, as well as acutely stimulating acid secretion. Gastrin also stimulates the production of members of the epidermal growth factor (EGF) family, which in turn inhibit parietal cell function but stimulate the growth of surface epithelial cells. Plasma gastrin concentrations are elevated in subjects with *Helicobacter pylori*, who are known to have increased risk of duodenal ulcer disease and gastric cancer. The use of gastrin or gastrin antagonists as a therapeutic agent may therefore contribute to treating major upper gastrointestinal tract disease.

Gastrin Inhibitory Peptides (SEQ ID NOS: 417–429)

Gastrin inhibitory peptide is a polypeptide of 43 amino acids that inhibits secretion of gastrin. A conjugated GIP could be used to treat severe peptic ulcer disease.

Motilin (SEQ ID NOS: 430–433)

Motilin is a polypeptide of 22 amino acids that controls gastrointestinal muscles. Motilin-producing cells are distributed in the duodenum, upper jejunum, and colorectal adenocarinomas and in midgut carcinoids. Motilin stimulates gut motility.

Secretin (SEQ ID NOS: 434–441)

Secretin is a polypeptide of 27 amino acids secreted from duodenum at pH values below 4.5, stimulates pancreatic acinar cells to release bicarbonate and $H_2O$. Secretin is a neurotransmitter (a chemical messenger) in the neuropeptide group. It is one of the hormones that controls digestion (gastrin and cholecystokinin are the others). It is a polypeptide composed of 27 amino acids and is secreted by cells in the digestive system when the stomach empties. Secretin stimulates the pancreas to emit digestive fluids that are rich in bicarbonate which neutralizes the acidity of the intestines, the stomach to produce pepsin (an enzyme that aids digestion of protein), and the liver to produce bile.

Secretin may be useful in treating autism. In one study, children with autistic spectrum disorders underwent upper gastrointestinal endoscopy and intravenous administration of secretin to stimulate pancreaticobiliary secretion. All three had an increased pancreaticobiliary secretory response when compared with nonautistic patients (7.5 to 10 mL/min versus 1 to 2 mL/min). Within 5 weeks of the secretin infusion, a significant amelioration of the children's gastrointestinal symptoms was observed, as was a dramatic improvement in their behavior, manifested by improved eye contact, alertness, and expansion of expressive language. These clinical observations suggest an association between gastrointestinal and brain function in patients with autistic behavior.

Vasoactive Intestinal Peptide (VIP) and Related Peptides (SEQ ID NOS: 442–464)

VIP is a polypeptide of 28 residues produced by hypothalamus and GI tract. It relaxes the GI, inhibits acid and pepsin secretion, acts as a neurotransmitter in peripheral autonomic nervous system, and increases secretion of $H_2O$ and electrolytes from pancreas and gut. It was originally discovered in lung and intestine and is also found in tissues including brain, liver, pancreas, smooth muscle and lymphocytes. It is structurally related to a family of peptides which include PACAP, PHI, secretin and glucagon. It has a diverse range of biological actions including vasodilation, electrolyte secretion, modulation of immune function and neurotransmission. A conjugated VIP may be useful in the treatment of achlorhydria, ischemic colitis and irritable bowel syndrome (IBS).

G. Natriuretic Peptides

There are three members in the natriuretic peptide hormone family, atrial natriuretic peptide (ANP), B-type natriuretic peptide (BNP, brain natriuretic peptide), and C-type natriuretic peptide (CNP), that are involved in the regulation of blood pressure and fluid homeostasis.

Atrial-Natriuretic Peptides (ANP) (SEQ ID NOS: 465–507)

ANP is a 28-amino acid peptide hormone containing a disulfide bond. It exerts natriuretic, diuretic, and vasorelaxant effects and play an important role in the body's blood volume and blood pressure homeostasis. See Smith, F. G. et al., J. Dev. Physiol. 12, 55 (1989). The mechanisms controlling ANP release have been the subject of intense research, and are now fairly well understood. The major determinant of ANP secretion is myocyte stretch. Although much less is known about the factors regulating BNP release from the heart, myocyte stretch has also been reported to stimulate BNP release from both atria and ventricles. However, whether wall stretch acts directly or via factors such as endothelin-1, nitric oxide, or angiotensin II liberated in response to distension has not been established. Recent studies show that by stimulating endothelin type A receptors endothelin plays an important physiological role as a mediator of acute-volume load-induced ANP secretion from atrial myocytes in conscious animals. In fact, endogenous paracrine/autocrine factors liberated in response to atrial wall stretch rather than direct stretch appears to be responsible for activation of ANP secretion in response to volume load, as evidenced by almost complete blockade of ANP secretion during combined inhibition of endothelin type A/B and angiotensin II receptors. Furthermore, under certain experimental conditions angiotensin II and nitric oxide may also exert a significant modulatory effect on stretch-activated ANP secretion. The molecular mechanisms by which endothelin-1, angiotensin II, and nitric oxide synergistically regulate stretch-activated ANP release are yet unclear. Abstract Volume 75 Issue 11/12 (1997) pp 876–885, Journal of Molecular Medicine. A conjugated would be useful in the management of malignant hypertension or severe hypertension and renal failure.

Brain Natriuretic Peptides (BNP) (SEQ ID NOS: 507–516)

Brain natriuretic peptide (BNP), a member of the natriuretic peptide family, is produced and released from cardiac ventricles. BNP regulates the body fluid volume, blood pressure, and vascular tones through the A-type guanylate cyclase-coupled receptor. The BNP plays a role in electrolyte-fluid homeostasis such as atrial natriuretic peptides (ANP). A conjugated BNP could be useful in the management of heart failure.

C-Type Natriuretic Peptides (CNP) (SEQ ID NOS: 517–524)

C-type natriuretic peptide (CNP), the third member of the natriuretic peptide family, is produced in vascular endothelial cells (ECs) and acts as an endothelium-derived relaxing peptide. Although atrial and brain natriuretic peptides are well known to be involved in the regulation of cardiovascular and endocrine functions as circulating hormones, the roles of the C-type natriuretic peptide (CNP) remain unknown.

CNP is found principally in the central nervous system and vascular endothelial cells while ANP and BNP are cardiac hormones. ANP is synthesized mainly in the atria of the normal adult heart, while BNP is produced by both the atria and ventricles.

H. Tachykinins (SEQ ID NOS: 525–627)

A family of peptides, including neurokinin A and substance P, that share a common C terminal sequence (F-X-GLM-NH2) which is required for full biological activity including Neurokinin A, B, and Substance P.

Neurokinin A

Neurokinin A is a decapeptide, previously known as substance K. It is is a member of the tachykinin family of neuropeptides which includes substance P and neurokinin B.

It exhibits a variety of activities related to smooth muscle contraction, pain transmission, bronchoconstriction, vasodilation and modulation of the immune system.

Neuromedin

Neuromedins, smooth-muscle-stimulating peptides, are commonly divided into four groups: bombesin-like, kassinin-like, neurotensin-like and neuromedins U. These neuropeptides and their receptors are localized to all components of the HPA hypophyseal pituitary axis, the only exemption seems to be neurokinin B, which is not detected in the adenohypophysis. Neuromedins exert a manifold effect on HPA axis, and their action on the adrenal suggests their involvement in the regulation of growth, structure and function of the adrenal cortex. Neuromedins may exert both direct and indirect effects on the adrenal cortex. Direct effect is proven by the stimulation of mineralo- and glucocorticoid therapeutic peptides by isolated or cultured adrenocortical cells and by mobilisation of intracellular [Ca2+]. Indirect effects, on the other hand, may be mediated by ACTH, arginine-vasopressin, angiotensin II, catecholamines or by other regulatory substances of medullary origin.

Substance P and Related Peptides

Substance P is an eleven amino acid peptide, first isolated from brain and intestine. It has been proposed as a neuromodulator involved in pain transmission in the spinal cord. It also affects contraction of smooth muscle, reduction of blood pressure, stimulation of secretory tissue, and release of histimine from mast cells.

I. Renin Related Peptides

Angiotensins (SEQ ID NOS: 628–677)

Angiotensin is a 10 amino acid peptide derived from enzymatic cleavage of a2-globin by the kidney enzyme renin. The C-terminal 2 amino acids are then released to yield angiotensin I, which is responsible for essential hypertension through stimulated synthesis and release of aldosterone from adrenal cells. It is a multifunctional hormone regulating blood pressure, plasma volume, neuronal function thirst, and water intake.

Angiotensin II is an octapeptide derived from angiotensin I by angiotensin converting enzyme, and is widely distributed both centrally and peripherally in organs such as the heart, the kidneys, and the liver. Angiotensin IV is the terminal hexapeptide fragment of angiotensin II formed metabolically by proteolytic cleavage from either angiotensin I or angiotensin II. It plays a role in vascular control, cardiac growth, renal blood flow and memory function.

Angiotensin II is the key peptide hormone that regulates vascular smooth muscle tone, blood pressure, free water intake and sodium retension. It controls vascular homeostasis compensating for loss of intravascular volume by stimulating increased vasospastic tone, increase sodium retention and increased free water intake.

Renin Substrates and Inhibitors (SEQ ID NOS: 678–684)

Renin is a very specific aspartic protease, which is synthesized and released by differentiated smooth muscle cells in the vasculature of the kidney called granular epithelial cells. Renin is specific for its substrate, angiotensinogen, which it cleaves specifically at the $Leu^{10}$-$Val^{11}$ bond to form the decapeptide, angiotensin I (AI). The renin-angiotensin system is involved in the control of fluid and mineral balance throughout the vertebrates. Renin can be found in mammals, birds, reptiles, amphibians, bony fishes, cartilaginous fishes, and agnathans. Specific renin inhibitors can also be designed, with therapeutic applications for treatment of for example hypertension and congestive heart failure (Blundell et al., 1987).

J. Endothelins and Related Peptides (SEQ ID NOS: 685–744)

The endothelin peptide family consists of the 21 amino acid isoforms endothelin-1, endothelin-2, endothelin-3, sarafotoxin (a snake venom) and scorpion toxin.

Endothelins (ET) and Big Endothelins

Endothelins are found on endothelial cells in a wide variety of organ systems. Examples of pathologies and physiological processes associated with changes in endothelin levels and synthetics include: atherosclerosis and hypertension, coronary vasospasm, acute renal failure, changes in intracellular Ca2+ levels, and effects on the renin-angiotensin system. Endothelins are released in reponse to variations in angiotensin II, vasopressin, and cytokines (e.g. TGF-$\beta$m TNF-$\alpha$, IL-$\beta$-) levels as well as other physiological events including increase blood flow.

The endothelin family of peptides consists of highly potent endogenous vasoconstrictor agents first isolated from endothelial cell supernatant. They regulate blood flow to organs by exporting a vasoconstrictive effect on arteries. Endothelins are derived from big-endothelin, which is cleaved by a unique membrane-bound metalloprotease, endothelin-converting enzyme, into the 21-amino-acid bioactive forms (ET-1, ET-2 and ET-3).

Of the 3 isoforms (ET-1, ET-2, ET-3), endothelin-1 is the major isoform and plays an important role for regulation of vascular function. Endogenous endothelin peptides and their receptors are differentially distributed throughout the many smooth muscle tissues including blood vessels, uterus, bladder and intestine. Through this widespread distribution and localization, they exert biological functions in regulating vascular tone and causing mitogenesis. ETs and their receptor subtypes are also present in various endocrine organs. It appears to act as a modulator of secretion of prolactin, gonadotropins GH and TSH. Endothelin may also be the disease marker or an etiologic factor in ischemic heart disease, atherosclerosis, congestive heart failure, renal failure, systemic hypertension, pulmonary hypertension, cerebral vasospasm.

Exogenously administered endothelin-1 has been demonstrated to increase peripheral resistance and blood pressure in a dose-dependent manner. However, during the first minutes of intravenous administration endothelins also decrease peripheral resistance and blood pressure, presumably due to the release of vasodilatory compounds such as nitric oxide, prostacyclin, and atrial natriuretic peptide.

ET(A) Receptor Antagonists

Endothelin receptors exist as two types: A (ET-A) and B (ET-B1 and ET-B2). ET-A receptors are responsible for while ET-B1 and ET-B2 mediate vasorelaxation and vasoconstriction respectively.

Sarafotoxln Peptides

As already described, endothelin (ET) peptides are potent growth factors binding to G protein-coupled receptors. Sarafotoxins (S6) isolated from *Atractaspis engaddensis* are highly homologous to endothelins. Sarafotoxin peptides have marked vasoconstrictive activity and are responsible for the ischemic limb loss that follows snake or scorpion bites. They could be used therapeutically as a peptidase stabalized peptide as a vasopressive agent in shock and sepsis.

K. Opioid Peptides (SEQ ID NOS: 745–927)

Opioids are a large class of drugs, used clinically as painkillers, that include both plant-derived and synthetic alkaloids and peptides found endogenously in the mammalian brain. While the plant-derived alkaloids have been known and used for thousands of years, the endogenous opioid peptides were discovered only in the mid-1970s.

Opioids include casomorphin peptides, demorphins, endorphins, enkephalins, deltorphins, dynorphins, and analogs and derivatives of these.

Casomorghin Peptides

Casomorphin peptides are novel opioid peptides derived from casein(§-casomorphins). Beta casomorphins are the more exstensive studied opioid peptides arising from food proteins (beta-caseins). They were originally isolated from bovine beta-casein, the same sequences occur in ovine and buffalo beta-caseins.

Dermorphins

Demorphin is a is a seven amino acid peptide, originally isolated from *Phylomedusa sauvagel* frog skin. It is a ligand which binds with high affinity to the μ opioid receptor, and has many biological roles including analgesia, endocrine modulation, immunomodulation, increased K$^+$ conductance and inhibition of action potentials.

Dynorphin/New-Endorphin Precursor Related Peptides

Dynorphins are a class of endogenous opioids that exist in multiple forms in the central nervous system. Dynorphins are derived from the precursor prodynorphin (proenkephalin B). Dynorphin, also known as Dynorphin A1-17, is a well known opioid which has the sequence Tyr-Gly-Gly-Phe-Leu$^5$-Arg-Arg-Ile-Arg-Pro$^{10}$-Lys-Leu-Lys-Trp-Asp$^{15}$-Asn-Gln. SEQ ID NO:1. A number of derivatives and analogs of dynorphin are known including Dyn A1-13, SEQ ID NO: 2 Dyn A2-13, SEQ ID NO:3, Dyn A1-12, Dyn A2-12 and Dyn A2-17 as well as amide analogs such as those mentioned in U.S. Pat. No. 4,462,941 of Lee et al., N-terminus truncated dynorphin analogs such as those described in International Patent Application WO 96/06626 of Lee et al. and des-Tyr or des-Tyr-Gly analogs such as those disclosed in International Patent Application WO 93/25217 also of Lee et al. The dynorphis are highly potent opioids, and demonstrate selective affinity for the kappa receptor. See Goldstein, A., Peptides, Structure and Function, Proceedings of the 8th American Peptides Symposiym, Hruby, V. J. and Rich, D. H., eds., 409 (1983).

Endorphins

The endorphis are derived from the precursor protein-lipotropin. They have been found to elicit several biological reactions such as analgesia, behavioral changes and growth hormone release. See Akil, H. et al., Ann. Rev. Neurosci., 7, 223 (1984).

Enkepalins & Related Peptides

Enkephalins and endorphins are neurohormones that inhibit transmission of pain impulses. The activity of neurons in both the central and peripheral nervous systems is affected by a large number of neurohormones that act on cells quite distant from their site of release. Neurohormones can modify the ability of nerve cells to respond to synaptic neurotransmitters. Several small peptides with profound effects on the nervous system have been discovered recently, for example enkephalins (e.g. Met-enkephalin and Leu-enkephalin) and endorphins (e.g. β endorphin). These three contain a common tetrapeptide sequence (Tyr-Gly-Gly-Phe) that is essential to their functions. Enkephalins and endorphins function as natural pain killers or opiates and decrease the pain responses in the central nervous system. See also Akil, H. et al., Ann. Rev. Neurosci., 7, 223 (1984).

L. Thymic Peptides (SEQ ID NOS: 928–934)

The thymus is thought to be responsible for the development and regulation of T cell immunity in both infants and adults. The thymus seems to exert its regulatory functions through the secretion of various noncellular, hormonelike products via its epithelial cells, called thymic peptides.

Thymic peptides are reported to have many effects on T cells. Several studies have reported that thymic peptides can assist development of immature, precursor cells into fully competent T cells. Thymic peptides seem to regulate the expression of various cytokine and monokine receptors on T cells and induce secretion of IL-2, interferon alpha, and interferon gamma (disease-fighting substances) when the immune system is challenged. There are reports that the use of thymic hormones in children with immuno-deficiencies caused by chemotherapy has resulted in an increase in circulating T cells, normalization of T cell subsets, and restoration of delayed hypersensitivity reactions.

Thymopoietin

Thymopoietin is the largest of the known thymic hormones and consists of 49 amino acids.

Thymulin

Previously known as thymic serum factor, thymulin is the smallest of the chemically characterized thymic hormones and consists of 9 amino acids. Thymulin is the hormone responsible for stimulating the production of immune-system T cells Thymopentin Thymopentin is a small, synthesized thymic peptide drug, also known as therapeutic peptide-5 or Timunox. In the U.S. it is being developed as an AIDS therapy by the Immunobiology Research Institute. Thymopentin has been studied more extensively than most other thymic peptide drugs. At least one study has claimed a significant rise in T cells and slight clinical improvement in those patients who received thymopentin three times a week, compared to untreated control participants. Compared to the 14 untreated control participants, those taking the drug showed greater "immunologic stability" and some clinical improvement.

Thymosin

Thymosin is a mixture of 15 or more proteins. One of these proteins is thymosin alpha-1 which consists of 28 amino acids. Thymosin has therapeutic use for the treatment of primary immunodeficiencies and as a booster for influenza vaccine in renal dialysis patients. It is also being tested in ongoing clinical trials for activity against chronic hepatitis B and C, HIV infection, and certain forms of cancer.

Thymic Humoral Factor (THF)

THF is a thymic peptide currently being examined as an anti-HIV treatment. In preclinical studies in rats with CMV-related immunosuppression, THF restored immune competence through modulation of T cells. In addition, it may have therapeutic use in the treatment of herpes, causing (at least in one study) the viral infection's rapid regression and increase of T-cell populations.

L. Other Peptides

Adrenomedullin Peptides (AM) (SEQ ID NOS: 935–945)

Adrenomedullin is a potent vasodilator peptide that exerts major effects on cardiovascular functions. Its systemic administration causes a rapid and profound fall in blood pressure and an increase in pulmonary blood flow. Its other actions are bronchodilatation, being an inhibitor of drinking behavior and an inhibitor of angiotensin-induced aldosterone secretion. See The Journal of Biological Chemistry, Vol. 270, No. 43, pp 25344–25347, 1995 and in the references cited therein Allatostatin Peptides (SEQ ID NOS: 946–949)

Allatostatins are 6–18 amino acid peptides synthesized by insects to control production of juvenile hormones, which in turn regulate functions including metamorphosis and egg production. While neuropeptides of the allatostatin family inhibit in vitro production of juvenile hormone, which modulates aspects of development and reproduction in the cockroach, *Diploptera punctata*, they are susceptible to inactivation by peptidases in the hemolymph, gut, and bound to internal tissues.

Amyloid Beta-Protein Fragments (Aβ Fragments) (SEQ ID NOS: 950–1010)

These are the principle component of the amyloid plaques that accumulate intracellularly and extracellularly in the neuritic plaques in the brain in Alzheimer's Disease. Aβ is a 4.5 kD protein, about 40–42 amino acids long, that is derived from the C-terminus of amyloid precursor protein (APP). APP is a membrane-spanning glycoprotein that, in the normal processing pathway, is cleaved inside the Aβ protein to produce α-sAPP, a secreted form of APP. Formation of α-sAPP precludes formation of Aβ. It has been proposed that Aβ accumulates by virtue of abnormal processing of APP, so that compounds that inhibit the activity of enzymes responsible for Aβ production are being sought. See, e.g., Wagner et al. Biotech. Report (1994/1995), pp. 106–107; and Selkoe (1993) TINS 16:403–409. Under certain conditions Aβ peptides first aggregate and then are deposited as a folded β-sheet structure that is characteristic of amyloid fibrils. β-amyloid (1–42) forms aggregates at a significantly greater rate and to a greater extent than β-amyloid (1–40).

Antimicrobial Peptides (SEQ ID NOS: 1011–1047)

Antimicrobial peptides are a key component of the innate immune systems of most multicellular organisms, being active against one or more microorganisms such as bacteria, fungi, protozoa, yeast, and mycobacteria. Examples of such peptides include defensin, cecropin, buforin, and magainin. Despite broad divergences in sequence and taxonomy, most antimicrobial peptides share a common mechanism of action, i.e. membrane permeabilization of the pathogen. They are classified in two broad groups: linear and cyclic. In the linear antimicrobial peptides, there are two subgroups: linear peptides tending to adopt α-helical amphipathic conformation and linear peptides of unusual composition, rich in amino acids such as Pro, Arg, or Trp. The cyclic group encompasses all cysteine-containing peptides, and can be further divided into two subgroups corresponding to single or multiple disulfide structures.

Most antimicrobial peptides provoke an increase in plasma membrane permeability. There is also evidence of other mechanisms, such as inhibition of specific membrane proteins, synthesis of stress proteins, arrest of DNA synthesis, breakage of single-strand DNA by defensins, interaction with DNA (without arrest of synthesis) by buforins, or production of hydrogen peroxide. Antimicrobial peptides can also act by triggering self-destructive mechanisms such as apoptosis in eukaryotic cells or autolysis in bacterial targets. Antimicrobial peptides are also known to act as inhibitors of enzymes produced by pathogenic organisms, either by serving as pseudo-substrates or by tight binding to the active sight that disturbs the access of the substrate.

Increased levels of antimicrobial peptides have been reported for several animal and human infections for example for α-defensins in *Mycobacterium, Pasteurella*, or *Cryptoporidium* infections and for a variety of peptides in blisters and wound fluid. Inflammatory situations or stimuli are also associated with induction of antibiotic peptides.

Depleted levels of antimicrobial peptides are associated to several pathologies. Thus, patients of specific granule-deficiency syndrome, completely lacking in α-defensins, suffer from frequent and severe bacterial infections. Low levels of histatins from saliva in HIV patients has been correlated with a higher incidence of oral candidiasis and fungal infections. Perhaps the most compelling illustration of the implication of antimicrobial peptides in human pathology comes from cystic fibrosis, a genetic disease associated with recurrent bacterial infections of the airways. The defective chloride channel causing the disease increases the salinity of the alveolar fluid, and thus impairs the bactericidal activity of β-defensins, which are salt sensitive. Andreu D, (Ed.)(1998) "*Antimicrobial peptides*" Biopolymers (Peptide Science) vol 47, N° 6, pp413–491. A. Andreu, L. Rivas (1998) *Animal Antimicrobial Peptides: An Overview*, Biopolymers (Pep. Sci.) 47: pp415–433.

Antioxidant Peptides (SEQ ID NOS: 1048–1050)

Antioxidants are agents that prevents oxidative damage to tissue. Mammalian cells are continuously exposed to activated oxygen species such as superoxide, hydrogen peroxide, hydroxyl radical, and singlet oxygen. These reactive oxygen intermediates are generated in vivo by cells in response to aerobic metabolism, catabolism of drugs and other xenobiotics, ultraviolet and x-ray radiation, and the respiratory burst of phagocytic cells (such as white blood cells) to kill invading bacteria such as those introduced through wounds. Hydrogen peroxide, for example, is produced during respiration of most living organisms especially by stressed and injured cells.

One example of antioxidant peptides is natural killer-enhancing factor B (NKEF-B), which belongs to a highly conserved family of recently discovered antioxidants. Natural killer-enhancing factor (NKEF) was identified and cloned on the basis of its ability to increase NK cytotoxicity. Two genes, NKEF-A and -B, encode NKEF proteins and sequence analysis presented suggests that each belongs to a highly conserved family of antioxidants. The role of NKEF-B as an antioxidant has been demonstrated by its protection of transfected cells to oxidative damage by hydrogen peroxide. NKEF-B has antioxidant activities toward prooxidants such as alkyl hydroperoxide and MeHg. Together with its antioxidant activity, the induction of NKEF-B by HP indicates that NKEF-B is an important oxidative stress protein providing protection against a variety of xenobiotic toxic agents.

Apoptosis Related Peptides (SEQ ID NOS: 1051–1075)

Animal cells can self-destruct via an intrinsic program of cell death (Steller, 1995). Apoptosis is a form of programmed cell death that is characterized by specific morphologic and biochemical properties (Wyllie et al., 1980). Morphologically, apoptosis is characterized by a series of structural changes in dying cells: blebbing (i.e. blistering) of the plasma membrane, condensation of the cytoplasm and nucleus, and cellular fragmentation into membrane apoptotic bodies (Steller, 1995; Wyllie et al., 1980).

Biochemically, apoptosis is characterized by the degradation of chromatin, initially into large fragments of 50–300 kilobases and subsequently into smaller fragments that are monomers and multimers of 200 bases (Oberhammer et al., 1993; Wyllie, 1980). Other biochemical indicators of apoptosis are induced or increased levels of the protein clusterin (Pearse et al., 1992), also known as TRPM-2 or SGP-2, and activation of the enzyme typeII transglutaminase, which crosslinks proteins to the envelope of apoptotc bodies (Fesus et al., 1991). Apoptosis is a complex phenomenon of related morphological and biochemical processes that can vary with tissue and cell type (Zakeri et al., 1995).

The execution of apoptosis minimizes the leakage of cellular constituents from dying cells (apoptosis causes the cell to involute). For example, proteases could damage adjacent cells or stimulate an inflammatory response. This cardinal feature of apoptosis distinguishes it from necrosis, which usually results from trauma that causes injured cells to swell and lyse, releasing the cytoplasmic material that stimulates an inflammatory response (Steller, 1995; Wyllie et al., 1980)

Bag Cell Peptides (BCP) (SEQ ID NOS: 1076–1080)

The neuropeptidergic bag cells of the marine mollusc *Aplysia californica* are involved in the egg-laying behavior of the animal. These neurosecretory cells synthesize an egg-laying hormone (ELH) precursor protein, yielding multiple bioactive peptides, including ELH, several bag cell peptides (BCP) and acidic peptide (AP). The bag cells of the marine mollusc *Aplysia californica* are well-characterized neuroendocrine cells that initiate egg laying. During sexual maturation, these cells (bag cell neurons), develop the capability of storing hormones that are released during periods of nervous system stimulation. The hormones are important to the process of egg laying, and so must not be released before the animal is sexually mature. Alpha-bag cell peptide belong to a small family of structurally related peptides that can elicit bag-cell activity in vitro.

Bombesin (SEQ ID NOS: 1081–1090)

Bombesin is a bioactive tetradecapeptide neuropeptide that belongs to a family of peptides sharing a common C terminal sequence, Trp-Ala-X-Gly-His-Met-NH2, and the N terminal region. It has a modulatory role found in nerves of the brain and gut that prevents gastric injury by release of endogenous gastrin. The mammalian homologue of bombesin is gastrin-releasing peptide (GRP).

Bone Gla Protein Peptides (SEQ ID NOS: 1091–1097)

Osteocalcin (bone Gla-protein, or BGP) is produced and secreted by osteoblasts in the process of bone formation. As with collagen, this protein is a component of bone matrix. Serum osteocalcin rises when bone formation rates increase. Levels are high during puberty when bone growth is most rapid. Often levels are also high in diseases having high bone turnover, such as hyperparathyroidism and hyperthyroidism. In postmenopausal osteoporosis, osteocalcin levels are sometimes increased, reflecting the increased turnover of bone secondary to rapid bone resorption. In senile osteoporosis, occurring in more elderly subjects, osteocalcin levels are more likely to be low, reflecting reduced rates of both bone turnover and bone formation. A treatment regimen that increases bone formation also raises the serum osteocalcin levels.

CART Peptides (SEQ ID NOS: 1098–1100)

Cocaine and amphetamine regulated transcript peptide (CART), is a recently discovered hypothalamic peptide with a potent appetite suppressing activity. In the rat the CART gene encodes a peptide of either 129 or 116 amino acid residues whereas only the short form exists in humans. The predicted signal sequence is 27 amino acid residues resulting in a prohormone of 102 or 89 residues. The C-terminal end of CART, consisting of 48 amino acid residues and 3 disulphide bonds, is thought to constitute a biologically active part of the molecule.

In the central nervous system CART is highly expressed in many hypothalamic nuclei, some of which are involved in regulating feeding behavior. The CART mRNA is regulated by leptin, and the expressed CART is a potent inhibitor of feeding that even overrides the feeding response induced by neuropeptide Y. The putative CART receptor is therefore a potential therapeutic target for an anti-obesity drug. See CART, a new anorectic peptide Thim L; Kristensen P; Larsen P J; Wulff B S, Int J Biochem Cell Biol, 30(12):1281–4 1998 December Cell Adhesion Peptides (SEQ ID NO: 1101)

Cellular adhesion peptides are directly involved in the cellular response to external stimuli. For example, during an inflammatory response, leukocytes must leave the plasma compartment and migrate to the point of antigenic insult. The mechanism of this migratory event is a complex interplay between soluble mediators and membrane-bound cellular adhesion molecules. Soluble cellular chemotactic factors, which are produced in the damaged tissue by a variety of resident cells, set up a chemical concentration gradient out to the plasma compartment. Interaction of these factors with their receptors on leukocytes leads to a directional migration of the leukocytes toward increasing concentrations of the chemotactic factor. Simultaneously, various adhesion peptides are upregulated on the leukocyte which mediate the initial rolling on the endothelial tissue, binding to a specific ligand on the activated endothelial tissue, and finally migration between endothelial cells into the tissue. The steps in this cascade of events are mediated by the interaction of specific cell surface proteins, termed "cell adhesion molecules such as, E-selectin (ELAM-1, endothelial leukocyte adhesion molecule-1), ICAM-1 (intercellular adhesion molecule-1), and VCAM-1 (vascular cell adhesion molecule-1).

Chemotactic Peptides (SEQ ID NOS: 1102–1113)

Chemotactic peptides are peptides that stimulate the migration of white cells, leukocytes and macrophages into tissues at the site of infection or injury or alternatively the prevent the migration of these same cells away from these sites.

Complement Inhibitors (SEQ ID NOS: 1114–1120)

Inhibition of complement attack on xenotransplants may be accomplished by the use of complement inhibitors. The rejection of transplanted organs may involve both an extremely rapid hyperacute rejection (HAR) phase and a slower cellular rejection phase. HAR of xenotransplants is initiated by preformed "natural" antibodies that bind to donor organ endothelium and activate complement attack by the recipient immune system. Activation of complement leads to the generation of fluid phase (C3a, C5a) and membrane bound (C3b and C5b-9, i.e., C5b, C6, C7, C8, and C9) proteins with chemotactic, procoagulant, proinflammatory, adhesive, and cytolytic properties. Complement inhibitors inhibit this process.

Cortistatin Peptides (SEQ ID NOS: 1121–1124)

Cortistatin, whose mRNA accumulates during sleep deprivation, apparently acts by antagonizing the effects of acetylcholine on cortical excitability, thereby causing synchronization brain slow waves. Cortistatin-14 (CST-14) shares 11 of its 14 residues with somatostafin-14 (SRIF-14), yet its effects on sleep physiology, locomotor behavior and hippocampal function are quite different from those of somatostatin.

Fibronectin Fragments & Fibrin Related Peptides (SEQ ID NOS: 1125–1174)

Fibronectin is a large glycoprotein that is composed of blocks of three types of repeating, homologous peptide sequences. Several of the homologous blocks form functional domains that are organized in a linear array on two nearly identical subunit arms. Each arm can be divided into functional domains, which are often referred to by one of the substances which bind in that region, for example the heparin-binding fragment, the fibrin binding fragment, and the cell-binding fragment. In several cell types, the Arg-Gly-Asp (RGD) sequence in the cell-binding domain of fibronectin interacts with a cell-surface glycoprotein designated Iib/IIIa. Fibronectin also binds to extracellular and basement-membrane components, to the envelope glycoprotein of viruses, to a variety of bacteria including staphylococci and streptococci, and to parasites such as *Trypanosoma cruzi* and *Leishmania* species.

Fibronectin has several adhesive functions, for example cell-to-cell adhesion, cell-to-basement-membrane attachment, and clot stabilization. In addition, fibronectin promotes embryogenesis, nerve regeneration, fibroblast migration, macrophage function, and pathogen (virus, fungus, bacteria, and protozoa) binding to mammalian cells and extracellular matrix. Thus, fibronectin is involved in the pathogenesis of infections from the initiation of the infection through the final stages of wound healing. See Proctor, R. A., Rev. Infect. Dis., 9, 317 (1987).

FMRF and Analog Peptides (SEQ ID NOS: 1175–1187)

FMRF are neuropeptides encoded in the FMRF amide gene and have a common C-terminal FMRFamide but different N-terminal extensions. FMRFamide-related peptides (FaRPs) are present throughout the animal kingdom and affect both neural and gastrointestinal functions. Organisms have several genes encoding numerous FaRPs with a common C-terminal structure but different N-terminal amino acid extensions.

Galanin & Related Peptides (SEQ ID NOS: 1188–1208)

Galanin is a 29–30 amino acid peptide originally isolated from pig small intestine. It is found in two biologically active forms: GAL (1-19), and GAL (1-30), a non-amidated form. It has many biological roles including: the inhibition of the release of biogenic amines in the hypothalamus, the pre- and post-synaptic inhibition of cholinergic function, the maintenance of gastrointestinal homeostasis, and the regulation of insulin and glucagon secretion.

Growth Factors & Related Peptides (SEQ ID NOS: 1209–1240)

Growth factors are a family of proteins that regulate cell division. Some growth factors are cell type specific, stimulating division of only those cells with appropriate receptors. Other growth factors are more general in their effects. There are also extracellular factors that antagonize the effects of growth factors, slowing or preventing division (for example transforming growth factor beta and tumor necrosis factor). These extracellular signals act through cell surface receptors very similar to those for hormones, and by similar mechanisms: the production of intracellular second messangers, protein phosphorylation, and ultimately, alteration of gene expression.

Gtherapeutic Peptide-Binding Protein Fragments (SEQ ID NOS: 1241–1246)

Members of a family of Gtherapeutic peptide-binding regulatory proteins (G-proteins) transduce signals from membrane-bound receptors to intracellular effectors. The family includes $G_s$ and $G_i$, which are responsible for simulation and inhibition, respectively, of adenylate cyclase. Transducin (T), localized in the disc membranes of retinal rod outer segments, couples activation of rhodopsin by light to increased cyclinc GMP phosphodiesterase activity. $G_o$, found originally in bovine brain, is a fourth member of the family.

Purified G proteins have similar physical properties. They are heterodimers composed of $\alpha$, $\beta$, and $\gamma$ subunits. The $\alpha$ subunits bind and hydrolyze Gtherapeutic peptide. See S. M. Mumby et al., PNAS 83, 265 (1986) and Lehninger p. 764.

Guanylin and Uroguanylin (SEQ ID NOS: 1247–1249)

Guanylin and uroguanylin are peptides isolated from intestinal mucosa, and urine, which regulate cyclic GMP production in enterocytes bind to and activate guanylate cyclase C and control salt and water transport in many epithelia in vertebrates, mimicking the action of several heat-stable bacteria enterotoxins. In the kidney, both of them have well-documented natriuretic and kaliuretic effects.

Chloride secretion in the intestine is regulated by these hormones via activation of guanylate cyclase C (GC-C). Both peptides are expressed in a variety of tissues and organs, including the kidney. In the isolated perfused kidney and in vivo these hormones induce natriuresis and diuresis, however, localisation and cellular mechanisms of their action in the kidney are still unknown.

Inhibin Peptides (SEQ ID NOS: 1250–1255)

Inhibin is composed of two subunits ($\alpha$ is 134 amino acids; $\beta$ is 115 and 116 amino acids). Its role is inhibition of FSH secretion. The two inhibin isoforms, inhibin A and inhibin B, are produced by the gonads in the course of gamete maturation and have different patterns of secretion during the menstrual cycle. Inhibins are also produced by the placenta and fetal membranes and may be involved in physiological adaptation of pregnancy. Clinically, inhibins may serve as sensitive tumor markers in postmenopausal women, or as useful tools for evaluating ovarian reserve in infertile women; they may also be used in the diagnosis of materno-fetal disorders and to prevent maturation of the ovum or to inhibit ovulation.

Interleukin (IL) and Interleukin Receptor Proteins (SEQ ID NOS: 1256–1263)

Interleukins are growth factors targeted to cells of hematopoietic origin. A variety of biological activities associated with immune and inflammatory responses have been ascribed to interleukins. These responses include fever, cartilage breakdown, bone resorption, thymocyte proliferation, activation of T and B lymphocytes, induction of acute-phase protein synthesis from hepatocytes, fibroblast proliferation, and differentiation and proliferation of bone marrow cells.

Laminin Fragments (SEQ ID NOS: 1264–1284)

Laminin, the major noncollagenous glycoprotein of basement membranes, has been shown to promote the adhesion, spreading, and migration of a variety of tumor cell types in vitro. In particular, the major current studies in the laboratory utilize intact laminin, purified proteolytic fragments of laminin, and synthetic peptides of laminin to identify functionally active sites on this large protein. Components of such basement membranes are important modulators of growth, development, and differentiation for various cell types. A conjugated laminin could be used to prevent inflamation or fibrosis in tissues.

This category also includes the peptide kringle-5 (or K-5). As used herein, the term "kringle 5" refers to the region of mammalian plasminogen having three disulfide bonds which contribute to the specific three-dimensional confirmation defined by the fifth kringle region of the mammalian plasminogen molecule. One such disulfide bond links the cysteine residues located at amino acid positions 462 and 541, a second links the cysteine residues located at amino acid positions 483 and 524 and a third links the cysteine residues located at amino acid positions 512 and 536. The term "kringle 5 peptide peptides" refers to peptides with anti-angiogenic activity of between 4 and 104 amino acids (inclusive) with a substantial sequence homology to the corresponding peptide fragment of mammalian plasminogen.

Leptin Fragment Peptides (SEQ ID NOS: 1285–1281)

Leptin, the protein product of the obesity gene, is secreted by fat cells. Leptin is involved in the regulation of bodyweight and metabolism in man and might also be involved in the pathophysiology of the insulin resistance syndrome, which is associated with the development of cardiovascular diseases Leucokinins (SEQ ID NOS: 1289–98)

Leucokinins are a group of widespread insect hormones that stimulate gut motility and tubule fluid secretion rates. In tubules, their major action is to raise chloride permeability by binding to a receptor on the basolateral membrane.

Pituitary Adenylate Cyclase Activating Polypeptide (PACAP) (SEQ ID NOS: 1299–1311)

It is a thirty-eight amino acid peptide first isolated from ovine hypothalamus, which also occurs in a 27 amino acid form called PACAP-27. PACAP has been localized in the hypothalamus, elsewhere in the brain, respiratory tract and gastrointestinal system. It has many biological actions, including neurotransmitter and hormonal functions, involvement in regulation of energy metabolism, and neuronal cytoprotective activity.

Pancreastatin (SEQ ID NOS: 1312–1324)

Pancreastatin is a 49 amino acid peptide first isolated, purified and characterized from porcine pancreas. Its biological activity in different tissues can be assigned to the C-terminal part of the molecule. Pancreastatin has a prohormonal precursor, chromogranin A, which is a glycoprotein present in neuroendocrine cells, including the endocrine pancreas Polypeptides (SEQ ID NOS: 1325–1326)

These are repetitive chains. Two examples are provided: (pro-Hyp-Gly)10*20H20 and Poly-L-Lysine Hydrochloride.

Signal Transduction Reagents (SEQ ID NOS: 1327–1367)

Signal transduction is the process by which an extracellular signal (for example chemical, mechanical, or electrical) is amplified and converted to a cellular response. Many reagents are involved in this process, for example achatin-1, glycogen synthase, autocamtide 2, calcineurin autoinhibitory peptide, calmodulin dependent protein kinase II, calmodulin dependent protein kinase substrate, calmodulin dependent protein kinase substrate analog, CKS-17, Cys-Kemptide, autocamtide 2, malantide, melittin, phosphate acceptor peptide, protein kinase C fragments, P34cd2 kinase fragment, P60c-src substrate II, protein kinase A fragments, tyrosine protein kinase substrate, syntide 2, S6 kinase substrate peptide 32, tyrosine specific protein kinase inhibitor, and their derivatives and fragments.

Thrombin Inhibitors (SEQ ID NOS: 1368–1377)

Thrombin is a key regulatory enzyme in the coagulation cascade; it serves a pluralistic role as both a positive and negative feedback regulator. In addition to its direct effect on hemostasis, thrombin exerts direct effects on diverse cell types that support and amplify pathogenesis of arterial thrombus disease. The enzyme is the strongest activator of platelets causing them to aggregate and release substances (eg. ADP TXA.sub.2 NE) that further propagate the thrombotic cycle. Platelets in a fibrin mesh comprise the principal framework of a white thrombus. Thrombin also exerts direct effects on endothelial cells causing release of vasoconstrictor substances and translocation of adhesion molecules that become sites for attachment of immune cells. In addition, the enzyme causes mitogenesis of smooth muscle cells and proliferation of fibroblasts. From this analysis, it is apparent that inhibition of thrombin activity by thrombin inhibitors constitutes a viable therapeutic approach towards the attenuation of proliferative events associated with thrombosis.

Toxins (SEQ ID NOS: 1378–1415)

A toxin can be conjugated using the present invention to target cancer cells, receptors, viruses, or blood cells. Once the toxin binds to the target cells the toxin is allowed to internalize and cause cell toxicity and eventually cell death. Toxins have been widely used as cancer therapeutics.

One example of a class of toxins is the mast cell degranulating peptide, a cationic 22-amino acid residue peptide with two disulfide bridges isolated from bee venom, causes mast cell degranulation and histamine release at low concentrations and has anti-inflammatory activity at higher concentrations. It is a powerful anti-inflammatory, more than 100 times more effective than hydrocortisone in reducing inflammation. Because of these unique immunologic properties, MCD peptide may serve as a useful tool for studying secretory mechanisms of inflammatory cells such as mast cells, basophils, and leukocytes, leading to the design of compounds with therapeutic potential. An example of a mast cell degranulating peptide is mastoparans, originating from wasp venom. It degranulates mast cells in the concentration of 0.5 µg/ml and releases histamine from the cells in the same concentration. See I Y. Hirai et al., Chem. Pharm. Bull. 27, 1942 (1979).

Other examples of such toxins include omega-agatoxin TK, agelenin, apamin, calcicudine, calciseptine, charbdotoxin, chlorotoxin, conotoxins, endotoxin inhibitors, gegraphutoxins, iberiotoxin, kaliotoxin, mast cell degranulating peptides, margatoxin, neurotoxin NSTX-3, PLTX-II, scyllatoxin, stichodactyla toxin, and derivatives and fragments thereof.

Trypsin Inhibitors (SEQ ID NOS: 1416–1418)

Trypsin inhibitors functions as an inhibitors of trypsin, as well as other serine proteases. Useful for treatment of lung inflammation, pancreatitis, myocardial infarction, cerebrovascular ischemia Virus Related Peptides (SEQ ID NOS: 1419–1529)

Virus related peptides are proteins related to viruses, for example virus receptors, virus inhibitors, and envelope proteins. Examples include but are not limited to peptide inhibitors of human immunodeficiency virus (HIV), respiratory syncytial virus (RSV), human parainfluenza virus (HPV), measles virus (MeV), and simian immunodeficiency virus (SIV), fluorogenic Human CMV Protease Substrate, HCV Core Protein, HCV NS4A Protein, Hepatitis B Virus Receptor Binding Fragment, Hepatitis B Virus Pre-S Region, Herpes Virus Inhibitor 2, HIV Envelope Protein Fragment, HIV gag fragment, HIV substrate, HIV-1 Inhibitory Peptide, peptide T, T21, V3 decapeptide, Virus Replication Inhibitor Peptide, and their fragments and derivatives.

These peptides can be administered therapeutically. For example, peptide T is a chain of 8 amino acids from the V2 region of HIV-1 gp120. These amino acids look like a portion of HIV's outer envelope. It is under investigation as a treatment for HIV-related neurological and constitutional symptoms, as peptide T may be able to alleviate symptoms like fevers, night sweats, weight loss, and fatigue. It has also been shown to resolve psoriatic lesions.

Miscellaneous Peptides (SEQ ID NOS: 1529–1617)

Including adjuvant peptide analogs, alpha mating factor, antiarrhythmic peptide, anorexigenic peptide, alpha-1 antitrypsin, bovine pineal antireproductive peptide, bursin, C3 peptide P16, cadherin peptide, chromogranin A fragment, contraceptive tetrapeptide, conantokin G, conantokin T, crustacean cardioactive peptide, C-telopeptide, cytochrome b588 peptide, decorsin, delicious peptide, delta-sleep-inducing peptide, diazempam-binding inhibitor fragment, nitric oxide synthase blocking peptide, OVA peptide, platelet calpain inhibitor (P1), plasminogen activator inhibitor 1, rigin, schizophrenia related peptide, sodium potassium Atherapeutic peptidease inhibitor-1, speract, sperm activating peptide, systemin, thrombin receptor agonist (three peptides), tuftsin, adipokinetic hormone, uremic pentapeptide, Antifreeze Polypeptide, tumor necrosis factor, leech [Des Asp10]Decorsin, L-Ornithyltaurine Hydrochloride, p-Aminophenylacetyl Tuftsin, Ac-Glu-Glu-Val-Val-Ala-Cys-pNA, Ac-Ser-Asp-Lys-Pro, Ac-rfwink-NH2, Cys-Gly-Tyr-Gly-Pro-Lys-Lys-Lys-Arg-Lys-Val-Gly-Gly, DAla-Leu, D-D-D-D-D, D-D-D-D-D-D, N-P-N-A-N-

P-N-A, V-A-I-T-V-L-V-K, V-G-V-R-V-R, V-I-H-S, V-P-D-P-R, Val-Thr-Cys-Gly, R-S-R, Sea Urchin Sperm Activating Peptide, SHU-9119 MC3-R & MC4-R Antagonist, glaspimod (immunostimulant, useful against bacterial infections, fungal infections, immune deficiency immune disorder, leukopenia), HP-228 (melanocortin, useful against chemotherapy induced emesis, toxicity, pain, diabetes mellitus, inflammation, rheumatoid arthritis, obesity), alpha 2-plasmin inhibitor (plasmin inhibitor), APC tumor suppressor (tumor suppressor, useful against neoplasm), early pregnancy factor (immunosuppressor), endozepine diazepam binding inhibitor (receptor peptide), gamma interferon (useful against leukemia), glandular kallikrei n-1 (immunostimulant), placental ribonuclease inhibitor, sarcolecin binding protein, surfactant protein D, wilms' tumor suppressor, wilm's tumor suppressor, GABAB 1b receptor peptide, prion related peptide (iPrP13), choline binding protein fragment (bacterial related peptide), telomerase inhibitor, cardiostatin peptide, endostatin derived peptide (angiogenesis inhibitor), prion inhibiting peptide, N-methyl D-aspartate receptor antagonist, C-peptide analog (useful against diabetic complications).

2. Modified Therapeutic Peptides

This invention relates to modified therapeutic peptides and their derivatives. The modified therapeutic peptides of the invention include reactive groups which can react with available reactive functionalities on blood components to form covalent bonds. The invention also relates to such modifications, such combinations with blood components and methods for their use. These methods include extending the effective therapeutic in vivo half life of the modified therapeutic peptides.

To form covalent bonds with functionalities on a protein, one may use as a reactive group a wide variety of active carboxyl groups, particularly esters, where the hydroxyl moiety is physiologically acceptable at the levels required to modify the therapeutic peptide. While a number of different hydroxyl groups may be employed in these linking agents, the most convenient would be N-hydroxysuccinimide (NHS), and N-hydroxy-sulfosuccinimide (sulfo-NHS).

Primary amines are the principal targets for NHS esters as diagramed in schematic 1A below. Accessible α-amine groups present on the N-termini of proteins react with NHS esters. However, α-amino groups on a protein may not be desirable or available for the NHS coupling. While five amino acids have nitrogen in their side chains, only the ε-amine of lysine reacts significantly with NHS esters. An amide bond is formed when the NHS ester conjugation reaction reacts with primary amines releasing N-hydroxysuccinimide as demonstrated in schematic 1A below.

Schematic 1A
NHS-Ester Reaction Scheme

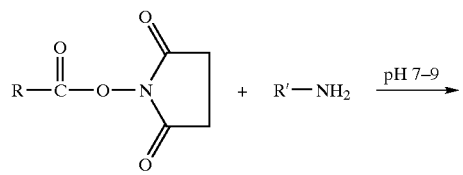

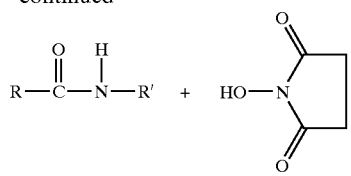

In the preferred embodiments of this invention, the functionality on the protein will be a thiol group and the reactive group will be a maleimido-containing group such as gamma-maleimide-butyralamide (GMBA) or MPA. The maleimido group is most selective for sulfhydryl groups on peptides when the pH of the reaction mixture is kept between 6.5 and 7.4 as shown in schematic 1B below. At pH 7.0, the rate of reaction of maleimido groups with sulfhydryls is 1000-fold faster than with amines. A stable thioether linkage between the maleimido group and the sulfhydryl is formed which cannot be cleaved under physiological conditions.

Maleimide Reaction Scheme

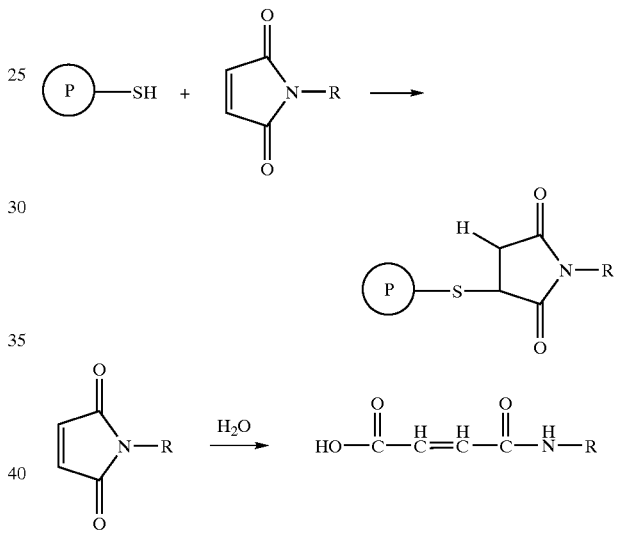

The therapeutic peptides and peptide derivatives of the invention may be modified for specific labeling and non-specific labeling of blood components.

A. Specific Labeling

Preferably, the therapeutic peptides of this invention are designed to specifically react with thiol groups on mobile blood proteins. Such reaction is preferably established by covalent bonding of a therapeutic peptide modified with a maleimide link (e.g. prepared from GMBS, MPA or other maleimides) to a thiol group on a mobile blood protein such as serum albumin or IgG.

Under certain circumstances, specific labeling with maleimides offers several advantages over non-specific labeling of mobile proteins with groups such as NHS and sulfo-NHS. Thiol groups are less abundant in vivo than amino groups. Therefore, the maleimide derivatives of this invention will covalently bond to fewer proteins. For example, in albumin (the most abundant blood protein) there is only a single thiol group. Thus, therapeutic peptide-maleimide-albumin conjugates will tend to comprise approximately a 1:1 molar ratio of therapeutic peptide to albumin. In addition to albumin, IgG molecules (class II) also have free thiols. Since IgG molecules and serum albumin make up the majority of the soluble protein in blood they also make up the majority of the free thiol groups in blood that are available to covalently bond to maleimide-modified therapeutic peptides.

Further, even among free thiol-containing blood proteins, specific labeling with maleimides leads to the preferential formation of therapeutic peptide-maleimide-albumin conjugates, due to the unique characteristics of albumin itself. The single free thiol group of albumin, highly conserved among species, is located at amino acid residue 34 ($Cys^{34}$). It has been demonstrated recently that the $Cys^{34}$ of albumin has increased reactivity relative to free thiols on other free thiol-containing proteins. This is due in part to the very low pK value of 5.5 for the $Cys^{34}$ of albumin. This is much lower than typical pK values for cysteines residues in general, which are typically about 8. Due to this low pK, under normal physiological conditions $Cys^{34}$ of albumin is predominantly in the ionized form, which dramatically increases its reactivity. In addition to the low pK value of $Cys^{34}$, another factor which enhances the reactivity of $Cys^{34}$ is its location, which is in a crevice close to the surface of one loop of region V of albumin. This location makes $Cys^{34}$ very available to ligands of all kinds, and is an important factor in $Cys^{34}$'s biological role as free radical trap and free thiol scavenger. These properties make $Cys^{34}$ highly reactive with therapeutic peptide-maleimides, and the reaction rate acceleration can be as much as 1000-fold relative to rates of reaction of therapeutic peptide-maleimides with other free-thiol containing proteins.

Another advantage of therapeutic peptide-maleimide-albumin conjugates is the reproducibility associated with the 1:1 loading of peptide to albumin specifically at $Cys^{34}$. Other techniques, such as glutaraldehyde, DCC, EDC and other chemical activations of, for example, free amines lack this selectivity. For example, albumin contains 52 lysine residues, 25–30 of which are located on the surface of albumin and accessible for conjugation. Activating these lysine residues, or alternatively modifying peptides to couple through these lysine residues, results in a heterogenous population of conjugates. Even if 1:1 molar ratios of peptide to albumin are employed, the yield will consist of multiple conjugation products, some containing 0, 1, 2 or more peptides per albumin, and each having peptides randomly coupled at any one of the 25–30 available lysine sites. Given the numerous combinations possible, characterization of the exact composition and nature of each batch becomes difficult, and batch-to-batch reproducibility is all but impossible, making such conjugates less desirable as a therapeutic. Additionally, while it would seem that conjugation through lysine residues of albumin would at least have the advantage of delivering more therapeutic agent per albumin molecule, studies have shown that a 1:1 ratio of therapeutic agent to albumin is preferred. In an article by Stehle, et al., "The Loading Rate Determines Tumor Targeting Properties of Methotrexate-Albumin Conjugates in Rats," *Anti-Cancer Drugs*, Vol. 8, pp. 677–685 (1997), incorporated herein in its entirety, the authors report that a 1:1 ratio of the anti-cancer methotrexate to albumin conjugated via glutaraldehyde gave the most promising results. These conjugates were taken up by tumor cells, whereas conjugates bearing 5:1 to 20:1 methotrexate molecules had altered HPLC profiles and were quickly taken up by the liver in vivo. It is postulated that at these higher ratios, conformational changes to albumin diminish its effectiveness as a therapeutic carrier.

Through controlled administration of maleimide-therapeutic peptides in vivo, one can control the specific labeling of albumin and IgG in vivo. In typical administrations, 80–90% of the administered maleimide-therapeutic peptides will label albumin and less than 5% will label IgG. Trace labeling of free thiols such as glutathione will also occur. Such specific labeling is preferred for in vivo use as it permits an accurate calculation of the estimated half-life of the administered agent.

In addition to providing controlled specific in vivo labeling, maleimide-therapeutic peptides can provide specific labeling of serum albumin and IgG ex vivo. Such ex vivo labeling involves the addition of maleimide-therapeutic peptides to blood, serum or saline solution containing serum albumin and/or IgG. Once modified ex vivo with maleimide-therapeutic peptides, the blood, serum or saline solution can be readministered to the blood for in vivo treatment.

In contrast to NHS-peptides, maleimide-therapeutic peptides are generally quite stable in the presence of aqueous solutions and in the presence of free amines. Since maleimide-therapeutic peptides will only react with free thiols, protective groups are generally not necessary to prevent the maleimide-therapeutic peptides from reacting with itself. In addition, the increased stability of the peptide permits the use of further purification steps such as HPLC to prepare highly purified products suitable for in vivo use. Lastly, the increased chemical stability provides a product with a longer shelf life.

B. Nonspecific Labeling

The therapeutic peptides of the invention may also be modified for non-specific labeling of blood components. Bonds to amino groups will generally be employed, particularly with the formation of amide bonds for non-specific labeling. To form such bonds, one may use as a chemically reactive group coupled to the therapeutic peptide a wide variety of active carboxyl groups, particularly esters, where the hydroxyl moiety is physiologically acceptable at the levels required. While a number of different hydroxyl groups may be employed in these linking agents, the most convenient would be N-hydroxysuccinimide (NHS) and N-hydroxy-sulfosuccinimide (sulfo-NHS).

Other linking agents which may be utilized are described in U.S. Pat. No. 5,612,034, which is hereby incorporated herein.

The various sites with which the chemically reactive groups of the non-specific therapeutic peptides may react in vivo include cells, particularly red blood cells (erythrocytes) and platelets, and proteins, such as immunoglobulins, including IgG and IgM, serum albumin, ferritin, steroid binding proteins, transferrin, thyroxin binding protein, α-2-macroglobulin, and the like. Those receptors with which the derivatized therapeutic peptides react, which are not long-lived, will generally be eliminated from the human host within about three days. The proteins indicated above (including the proteins of the cells) will remain in the bloodstream at least three days, and may remain five days or more (usually not exceeding 60 days, more usually not exceeding 30 days) particularly as to the half life, based on the concentration in the blood.

For the most part, reaction will be with mobile components in the blood, particularly blood proteins and cells, more particularly blood proteins and erythrocytes. By "mobile" is intended that the component does not have a fixed situs for any extended period of time, generally not exceeding 5 minutes, more usually one minute, although some of the blood components may be relatively stationary for extended periods of time. Initially, there will be a relatively heterogeneous population of labeled proteins and cells. However, for the most part, the population within a few days after administration will vary substantially from the initial population, depending upon the half-life of the labeled proteins in the blood stream. Therefore, usually within about three days or more, IgG will become the predominant labeled protein in the blood stream.

Usually, by day 5 post-administration, IgG, serum albumin and erythrocytes will be at least about 60 mole %, usually at least about 75 mole %, of the conjugated components in blood, with IgG, IgM (to a substantially lesser extent) and serum albumin being at least about 50 mole %, usually at least about 75 mole %, more usually at least about 80 mole %, of the non-cellular conjugated components.

The desired conjugates of non-specific therapeutic peptides to blood components may be prepared in vivo by administration of the therapeutic peptides directly to the patient, which may be a human or other mammal. The administration may be done in the form of a bolus or introduced slowly over time by infusion using metered flow or the like.

If desired, the subject conjugates may also be prepared ex vivo by combining blood with modified therapeutic peptides of the present invention, allowing covalent bonding of the modified therapeutic peptides to reactive functionalities on blood components and then returning or administering the conjugated blood to the host. Moreover, the above may also be accomplished by first purifying an individual blood component or limited number of components, such as red blood cells, immunoglobulins, serum albumin, or the like, and combining the component or components ex vivo with the chemically reactive therapeutic peptides. The labeled blood or blood component may then be returned to the host to provide in vivo the subject therapeutically effective conjugates. The blood also may be treated to prevent coagulation during handling ex vivo.

3. Synthesis of Therapeutic Peptides Used in the Present Invention

Peptide fragments may be synthesized by standard methods of solid phase peptide chemistry known to those of ordinary skill in the art. For example, peptide fragments may be synthesized by solid phase chemistry techniques following the procedures described by Steward and Young (Steward, J. M. and Young, J. D., Solid Phase Peptide Synthesis, 2nd Ed., Pierce Chemical Company, Rockford, Ill., (1984) using an Applied Biosystem synthesizer. Similarly, multiple fragments may be synthesized then linked together to form larger fragments. These synthetic peptide fragments can also be made with amino acid substitutions at specific locations.

For solid phase peptide synthesis, a summary of the many techniques may be found in J. M. Stewart and J. D. Young, Solid Phase Peptide Synthesis, W. H. Freeman Co. (San Francisco), 1963 and J. Meienhofer, Hormonal Proteins and Peptides, vol. 2, p. 46, Academic Press (New York), 1973. For classical solution synthesis see G. Schroder and K. Lupke, The Peptides, Vol. 1, Acacemic Press (New York). In general, these methods comprise the sequential addition of one or more amino acids or suitably protected amino acids to a growing peptide chain. Normally, either the amino or carboxyl group of the first amino acid is protected by a suitable protecting group. The protected or derivatized amino acid is then either attached to an inert solid support or utilized in solution by adding the next amino acid in the sequence having the complimentary (amino or carboxyl) group suitably protected and under conditions suitable for forming the amide linkage. The protecting group is then removed from this newly added amino acid residue and the next amino acid (suitably protected) is added, and so forth.

After all the desired amino acids have been linked in the proper sequence, any remaining protecting groups (and any solid support) are removed sequentially or concurrently to afford the final polypeptide. By simple modification of this general procedure, it is possible to add more than one amino acid at a time to a growing chain, for example, by coupling (under conditions which do not racemize chiral centers) a protected tripeptide with a properly protected dipeptide to form, after deprotection, a pentapeptide.

A particularly preferred method of preparing compounds of the present invention involves solid phase peptide synthesis wherein the amino acid α-N-terminal is protected by an acid or base sensitive group. Such protecting groups should have the properties of being stable to the conditions of peptide linkage formation while being readily removable without destruction of the growing peptide chain or racemization of any of the chiral centers contained therein. Suitable protecting groups are 9-fluorenylmethyloxycarbonyl (Fmoc), t-butyloxycarbonyl (Boc), benzyloxycarbonyl (Cbz), biphenylisopropyloxycarbonyl, t-amyloxycarbonyl, isobornyloxycarbonyl, α,α-dimethyl-3,5-dimethoxybenzyloxycarbonyl, o-nitrophenylsulfenyl, 2-cyano-t-butyloxycarbonyl, and the like. The 9-fluorenylmethyloxycarbonyl (Fmoc) protecting group is particularly preferred for the synthesis of Itherapeutic peptide fragments. Other preferred side chain protecting groups are, for side chain amino groups like lysine and arginine, 2,2,5,7,8-pentamethylchroman-6-sulfonyl (pmc), nitro, p-toluenesulfonyl, 4-methoxybenzene-sulfonyl, Cbz, Boc, and adamantyloxycarbonyl; for tyrosine, benzyl, o-bromobenzyloxycarbonyl, 2,6-dichlorobenzyl, isopropyl, t-butyl (t-Bu), cyclohexyl, cyclopenyl and acetyl (Ac); for serine, t-butyl, benzyl and tetrahydropyranyl; for histidine, trityl, benzyl, Cbz, p-toluenesulfonyl and 2,4-dinitrophenyl; for tryptophan, formyl; for asparticacid and glutamic acid, benzyl and t-butyl and for cysteine, triphenylmethyl (trityl).

In the solid phase peptide synthesis method, the α-C-terminal amino acid is attached to a suitable solid support or resin. Suitable solid supports useful for the above synthesis are those materials which are inert to the reagents and reaction conditions of the stepwise condensation-deprotection reactions, as well as being insoluble in the media used. The preferred solid support for synthesis of α-C-terminal carboxy peptides is 4-hydroxymethylphenoxymethyl-copoly(styrene-1% divinylbenzene). The preferred solid support for α-C-terminal amide peptides is the 4-(2',4'-dimethoxyphenyl-Fmoc-aminomethyl)phenoxyacetamidoethyl resin available from Applied Biosystems (Foster City, Calif.). The α-C-terminal amino acid is coupled to the resin by means of N,N'-dicyclohexylcarbodiimide (DCC), N,N'-diisopropylcarbodiimide (DIC) or O-benzotriazol-1-yl-N,N,N',N'-tetramethyluronium-hexafluorophosphate (HBTU), with or without 4-dimethylaminopyridine (DMAP), 1-hydroxybenzotriazole (HOBT), benzotriazol-1-yloxy-tris(dimethylamino)phosphonium-hexafluorophosphate (BOP) or bis(2-oxo-3-oxazolidinyl)phosphine chloride (BOPCI), mediated coupling for from about 1 to about 24 hours at a temperature of between 10° and 50° C. in a solvent such as dichloromethane or DMF.

When the solid support is 4-(2',4'-dimethoxyphenyl-Fmoc-aminomethyl)phenoxy-acetamidoethyl resin, the Fmoc group is cleaved with a secondary amine, preferably piperidine, prior to coupling with the α-C-terminal amino acid as described above. The preferred method for coupling to the deprotected 4-(2',4'-dimethoxyphenyl-Fmoc-aminomethyl)phenoxy-acetamidoethyl resin is O-benzotriazol-1-yl-N,N,N',N'-tetramethyluroniumhexafluoro-phosphate (HBTU, 1 equiv.)

and 1-hydroxybenzotriazole (HOBT, 1 equiv.) in DMF. The coupling of successive protected amino acids can be carried out in an automatic polypeptide synthesizer as is well known in the art. In a preferred embodiment, the α-N-terminal amino acids of the growing peptide chain are protected with Fmoc. The removal of the Fmoc protecting group from the α-N-terminal side of the growing peptide is accomplished by treatment with a secondary amine, preferably piperidine. Each protected amino acid is then introduced in about 3-fold molar excess, and the coupling is preferably carried out in DMF. The coupling agent is normally O-benzotriazol-1-yl-N,N,N',N'-tetramethyluroniumhexafluorophosphate (HBTU, 1 equiv.) and 1-hydroxybenzotriazole (HOBT,1 equiv.).

At the end of the solid phase synthesis, the polypeptide is removed from the resin and deprotected, either in successively or in a single operation. Removal of the polypeptide and deprotection can be accomplished in a single operation by treating the resin-bound polypeptide with a cleavage reagent comprising thianisole, water, ethanedithiol and trifluoroacetic acid. In cases wherein the α-C-terminal of the polypeptide is an alkylamide, the resin is cleaved by aminolysis with an alkylamine. Alternatively, the peptide may be removed by transesterification, e.g. with methanol, followed by aminolysis or by direct transamidation. The protected peptide may be purified at this point or taken to the next step directly. The removal of the side chain protecting groups is accomplished using the cleavage cocktail described above. The fully deprotected peptide is purified by a sequence of chromatographic steps employing any or all of the following types: ion exchange on a weakly basic resin (acetate form); hydrophobic adsorption chromatography on underivitized polystyrene-divinylbenzene (for example, Amberlite XAD); silica gel adsorption chromatography; ion exchange chromatography on carboxymethylcellulose; partition chromatography, e.g. on Sephadex G-25, LH-20 or countercurrent distribution; high performance liquid chromatography (HPLC), especially reverse-phase HPLC on octyl- or octadecylsilyl-silica bonded phase column packing.

Molecular weights of these therapeutic peptides are determined using Fast Atom Bombardment (FAB) Mass Spectroscopy.

The therapeutic peptides of the invention may be synthesized with N- and C-terminal protecting groups for use as pro-drugs.

(1) N-Terminal Protective Groups

As discussed above, the term "N-protecting group" refers to those groups intended to protect the α-N-terminal of an amino acid or peptide or to otherwise protect the amino group of an amino acid or peptide against undesirable reactions during synthetic procedures. Commonly used N-protecting groups are disclosed in Greene, "Protective Groups In Organic Synthesis," (John Wiley & Sons, New York (1981)), which is hereby incorporated by reference. Additionally, protecting groups can be used as pro-drugs which are readily cleaved in vivo, for example, by enzymatic hydrolysis, to release the biologically active parent. α-N-protecting groups comprise loweralkanoyl groups such as formyl, acetyl ("Ac"), propionyl, pivaloyl, t-butylacetyl and the like; other acyl groups include 2-chloroacetyl, 2-bromoacetyl, trifluoroacetyl, trichloroacetyl, phthalyl, o-nitrophenoxyacetyl, -chlorobutyryl, benzoyl, 4-chlorobenzoyl, 4-bromobenzoyl, 4-nitrobenzoyl and the like; sulfonyl groups such as benzenesulfonyl, p-toluenesulfonyl and the like; carbamate forming groups such as benzyloxycarbonyl, p-chlorobenzyloxycarbonyl, p-methoxybenzyloxycarbonyl, p-nitrobenzyloxycarbonyl, 2-nitrobenzyloxycarbonyl, p-bromobenzyloxycarbonyl, 3,4-dimethoxybenzyloxycarbonyl, 3,5-dimethoxybenzyloxycarbonyl, 2,4-dimethoxybenzyloxycarbonyl, 4-ethoxybenzyloxycarbonyl, 2-nitro-4,5-dimethoxybenzyloxycarbonyl, 3,4,5-trimethoxybenzyloxycarbonyl, 1-(p-biphenylyl)-1-methylethoxycarbonyl, α,α-dimethyl-3,5-dimethoxybenzyloxycarbonyl, benzhydryloxycarbonyl, t-butyloxycarbonyl, diisopropylmethoxycarbonyl, isopropyloxycarbonyl, ethoxycarbonyl, methoxycarbonyl, allyloxycarbonyl, 2,2,2,-trichloroethoxycarbonyl, phenoxycarbonyl, 4-nitrophenoxycarbonyl, fluorenyl-9-methoxycarbonyl, cyclopentyloxycarbonyl, adamantyloxycarbonyl, cyclohexyloxycarbonyl, phenylthiocarbonyl and the like; arylalkyl groups such as benzyl, triphenylmethyl, benzyloxymethyl, 9-fluorenylmethyloxycarbonyl (Fmoc) and the like and silyl groups such as trimethylsilyl and the like.

(2) Carboxy Protective Groups

As discussed above, the term "carboxy protecting group" refers to a carboxylic acid protecting ester or amide group employed to block or protect the carboxylic acid functionality while the reactions involving other functional sites of the compound are performed. Carboxy protecting groups are disclosed in Greene, "Protective Groups in Organic Synthesis" pp. 152–186 (1981), which is hereby incorporated by reference. Additionally, a carboxy protecting group can be used as a pro-drug whereby the carboxy protecting group can be readily cleaved in vivo, for example by enzymatic hydrolysis, to release the biologically active parent. Such carboxy protecting groups are well known to those skilled in the art, having been extensively used in the protection of carboxyl groups in the penicillin and cephalosporin fields as described in U.S. Pat. Nos. 3,840,556 and 3,719,667, the disclosures of which are hereby incorporated herein by reference. Representative carboxy protecting groups are $C_1$–$C_8$ loweralkyl (e.g., methyl, ethyl or t-butyl and the like); arylalkyl such as phenethyl or benzyl and substituted derivatives thereof such as alkoxybenzyl or nitrobenzyl groups and the like; arylalkenyl such as phenylethenyl and the like; aryl and substituted derivatives thereofsuch as 5-indanyl and the like; dialkylaminoalkyl such as dimethylaminoethyl and the like); alkanoyloxyalkyl groups such as acetoxymethyl, butyryloxymethyl, valeryloxymethyl, isobutyryloxymethyl, isovaleryloxymethyl, 1-(propionyloxy)-1-ethyl, 1-(pivaloyloxyl)-1-ethyl, 1-methyl-1-(propionyloxy)-1-ethyl, pivaloyloxymethyl, propionyloxymethyl and the like; cycloalkanoyloxyalkyl groups such as cyclopropylcarbonyloxymethyl, cyclobutylcarbonyloxymethyl, cyclopentylcarbonyloxymethyl, cyclohexylcarbonyloxymethyl and the like; aroyloxyalkyl such as benzoyloxymethyl, benzoyloxyethyl and the like; arylalkylcarbonyloxyalkyl such as benzylcarbonyloxymethyl, 2-benzylcarbonyloxyethyl and the like; alkoxycarbonylalkyl or cycloalkyloxycarbonylalkyl such as methoxycarbonylmethyl, cyclohexyloxycarbonylmethyl, 1-methoxycarbonyl-1-ethyl and the like; alkoxycarbonyloxyalkyl or cycloalkyloxycarbonyloxyalkyl such as methoxycarbonyloxymethyl, t-butyloxycarbonyloxymethyl, 1-ethoxycarbonyloxy-1-ethyl, 1-cyclohexyloxycarbonyloxy-1-ethyl and the like; aryloxycarbonyloxyalkyl such as 2-(phenoxycarbonyloxy)ethyl, 2-(5-indanyloxycarbonyloxy)ethyl and the like; alkoxyalkylcarbonyloxyalkyl such as 2-(1-methoxy-2-methylpropan-2-oyloxy)ethyl and like; arylalkyloxycarbonyloxyalkyl such as 2-(benzyloxycarbonyloxy)ethyl and the like; arylalkenyloxycarbonyloxyalkyl such as 2-(3-phenylpropen-2-yloxycarbonyloxy)ethyl and the like; alkoxycarbornylaminoalkyl such as t-butyloxycarbonylaminomethyl and the like; alkylaminocarbonylaminoalkyl such as methylaminocarbonylaminomethyl and the like; alkanoylaminoalkyl such as acetylaminomethyl and the like; heterocycliccarbonyloxyalkyl such as 4-methylpiperazinylcarbonyloxymethyl and the like; dialkylaminocarbonylalkyl such as dimethylaminocarbonylmethyl, diethylaminocarbonylmethyl and the like; (5-(loweralkyl)-2-oxo-1,3-dioxolen-4-yl) alkyl such as (5-t-butyl-2-oxo-1,3-dioxolen-4-yl)methyl and the like; and (5-phenyl-2-oxo-1,3-dioxolen-4-yl)alkyl such as (5-phenyl-2-oxo-1,3-dioxolen-4-yl)methyl and the like.

Representative amide carboxy protecting groups are aminocarbonyl and loweralkylaminocarbonyl groups.

Preferred carboxy-protected compounds of the invention are compounds wherein the protected carboxy group is a loweralkyl, cycloalkyl or arylalkyl ester, for example, methyl ester, ethyl ester, propyl ester, isopropyl ester, butyl ester, sec-butyl ester, isobutyl ester, amyl ester, isoamyl ester, octyl ester, cyclohexyl ester, phenylethyl ester and the like or an alkanoyloxyalkyl, cycloalkanoyloxyalkyl, aroyloxyalkyl or an arylalkylcarbonyloxyalkyl ester. Preferred amide carboxy protecting groups are loweralkylaminocarbonyl groups. For example, aspartic acid may be protected at the α-C-terminal by an acid labile group (e.g. t-butyl) and protected at the β-C-terminal by a hydrogenation labile group (e.g. benzyl) then deprotected selectively during synthesis.

Alternatively, it is also possible to obtain fragments of the peptides by fragmenting the naturally occurring amino acid sequence, using, for example, a proteolytic enzyme according to methods well known in the art. Further, it is possible to obtain the desired fragments of the therapeutic peptide through the use of recombinant DNA technology using methods well known in the art.

4. Modification of Therapeutic Peptides

The manner of producing the modified therapeutic peptides of the present invention will vary widely, depending upon the nature of the various elements comprising the molecule. The synthetic procedures will be selected so as to be simple, provide for high yields, and allow for a highly purified stable product. Normally, the reactive group will be created as the last stage, for example, with a carboxyl group, esterification to form an active ester will be the last step of the synthesis. Specific methods for the production of modified therapeutic peptides of the present invention are described below.

Generally, the modified therapeutic peptides of the present invention may be made using blind or structure activity relationship (SAR) driven substitution. SAR is an analysis which defines the relationship between the structure of a molecule and its pharmacological activity for a series of compounds. Various studies relative to individual therapeutic peptides show how the activity of the peptide varies according to the variation of chemical structure or chemical properties. More specifically, first the therapeutic activity of the free peptide is assayed. Next, the peptide is modified according to the invention, either at the N-terminus, at the C-terminus, or in the interior of the peptide with the linking group only. The linking group will include the reactive group as discussed above. The therapeutic activity of this modified peptide-linking group is assayed next, and based on the detected activity a decision is made regarding the modification site. Next, the peptide conjugate is prepared and its therapeutic ativity is determined. If the therapeutic activity of the peptide after conjugation is not substantially reduced (i.e. if the therapeutic activity is reduced by less than 10 fold), then the stability of the peptide is measured as indicated by its in vivo lifetime. If the stability is not improved to a desired level, then the peptide is modified at an alternative site, and the procedure is repeated until a desired level of therapeutic activity and a desired stability are achieved.

More specifically, each therapeutic peptide selected to undergo the derivatization with a linker and a reactive group will be modified according to the following criteria: if a terminal carboxylic group is available on the therapeutic peptide and is not critical for the retention of pharmacological activity, and no other sensitive functional group is present on the therapeutic peptide, then the carboxylic acid will be chosen as attachment point for the linker-reactive group modification. If the terminal carboxylic group is involved in pharmacological activity, or if no carboxylic acids are available, then any other sensitive functional group not critical for the retention of pharmacological activity will be selected as the attachment point for the linker-reactive group modification. If several sensitive functional groups are available on a therapeutic peptide, a combination of protecting groups will be used in such a way that after addition of the linker/reactive group and deprotection of all the protected sensitive functional groups, retention of pharmacological activity is still obtained. If no sensitive functional groups are available on the therapeutic peptide, or if a simpler modification route is desired, synthetic efforts will allow for a modification of the original peptide in such a way that retention of biological activity and retention of receptor or target specificity is obtained. In this case the modification will occur at the opposite end of the peptide.

An NHS derivative may be synthesized from a carboxylic acid in absence of other sensitive functional groups in the therapeutic peptide. Specifically, such a therapeutic peptide is reacted with N-hydroxysuccinimide in anhydrous $CH_2Cl_2$ and EDC, and the product is purified by chromatography or recrystallized from the appropriate solvent system to give the NHS derivative.

Alternatively, an NHS derivative may be synthesized from a therapeutic peptide that contains an amino and/or thiol group and a carboxylic acid. When a free amino or thiol group is present in the molecule, it is preferable to protect these sensitive functional groups prior to perform the addition of the NHS derivative. For instance, if the molecule contains a free amino group, a transformation of the amine into a Fmoc or preferably into a tBoc protected amine is necessary prior to perform the chemistry described above. The amine functionality will not be deprotected after preparation of the NHS derivative. Therefore this method applies only to a compound whose amine group is not required to be freed to induce a pharmacological desired effect. If the amino group needs to be freed to retain the original biological properties of the molecule, then another type of chemistry described in example 3–6 has to be performed.

In addition, an NHS derivative may be synthesized from a therapeutic peptide containing an amino or a thiol group and no carboxylic acid. When the selected molecule contains no carboxylic acid, an array of bifunctional linkers can be used to convert the molecule into a reactive NHS derivative. For instance, ethylene glycol-bis(succinimydylsuccinate) (EGS) and triethylamine dissolved in DMF and added to the free amino containing molecule (with a ratio of 10:1 in favor of EGS) will produce the mono NHS derivative. To produce an NHS derivative from a thiol derivatized molecule, one can use N-[-maleimidobutyryloxy]succinimide ester (GMBS) and triethylamine in DMF. The maleimido group will react with the free thiol and the NHS derivative will be purified from the reaction mixture by chromatography on silica or by HPLC.

An NHS derivative may also be synthesized from a therapeutic peptide containing multiple sensitive functional groups. Each case will have to be analyzed and solved in a different manner. However, thanks to the large array of protecting groups and bifunctional linkers that are commercially available, this invention is applicable to any therapeutic peptide with preferably one chemical step only to derivatize the therapeutic peptide (as described in example 1 or 3) or two steps (as described in example 2 and involving prior protection of a sensitive group) or three steps (protection, activation and deprotection). Under exceptional circumstances only, would we require to use multiple steps (beyond three steps) synthesis to transform a therapeutic peptide into an active NHS or maleimide derivative.

A maleimide derivative may also be synthesized from a therapeutic peptide containing a free amino group and a free carboxylic acid. To produce a maleimide derivative from a amino derivatized molecule, one can use N-[γ-maleimidobutyryloxy]succinimide ester (GMBS) and triethylamine in DMF. The succinimide ester group will react with the free amino and the maleimide derivative will be purified from the reaction mixture by crystallization or by chromatography on silica or by HPLC.

Finally, a maleimide derivative may be synthesized from a therapeutic peptide containing multiple other sensitive functional groups and no free carboxylic acids. When the selected molecule contains no carboxylic acid, an array of bifunctional crosslinking reagents can be used to convert the molecule into a reactive NHS derivative. For instance maleimidopropionic acid (MPA) can be coupled to the free amine to produce a maleimide derivative through reaction of the free amine with the carboxylic group of MPA using HBTU/HOBt/DIEA activation in DMF. Alternatively, a lysine residue can be added on the C-terminus end of the peptide to allow for conjugation onto the -amino group of the lysine as described in the examples below. This added lysine allows for simple and efficient modification at the C-terminus of the peptide while keeping the terminal end capped by an amide function as designed by the initial choice of the resin Many other commercially available heterobifunctional crosslinking reagents can alternatively be used when needed. A large number of bifunctional compounds are available for linking to entities. Illustrative reagents include: azidobenzoyl hydrazide, N-[4-(p-azidosalicylamino)butyl]-3'-[2'-pyridyidithio)propionamide), bis-sulfosuccinimidyl suberate, dimethyl adipimidate, disuccinimidyl tartrate, N-y-maleimidobutyryloxysuccinimide ester, N-hydroxy sulfosuccinimidyl-4-azidobenzoate, N-succinimidyl[4-azidophenyl]-1,3'-dithiopropionate, N-succinimidyl[4-iodoacetyl]aminobenzoate, glutaraldehyde, and succinimidyl 4-[N-maleimidomethyl]cyclohexane-1-carboxylate.

Even more specifically, the peptides are preferably modified according to the nature of their substituants and the presence or absence of free cysteines. Most peptides can be gathered into three distinct categories: (1) peptides that contain no cysteines; (2) peptides that contain one cysteine, (3) peptides that contain two cysteines as a disulfide bridge (cystine); and (4) peptides that contain multiple cysteines.

A. Peptides that Contain No Cysteines

Where the peptide contains no cysteine, addition from the C terminus is performed with all residues cleaved from the support resin and fully protected. Solution phase activation of C-terminus with EDC and NHS can be reacted with an amino-alkyl-maleimide in one pot. The peptide is then fully deprotected. Alternatively, a lysine residue can be added on the C-terminus of the peptide to allow modification at the epsilon amino group of the lysine while keeping the carboxy terminus capped with an amide group. Such an addition of a lysine residue is preferably performed only where the addition does not substantially affect the therapeutic activity of the peptide. The generalized reaction scheme for C-terminus modification of peptides that contain no cysteines illustrated in the schematic diagram below.

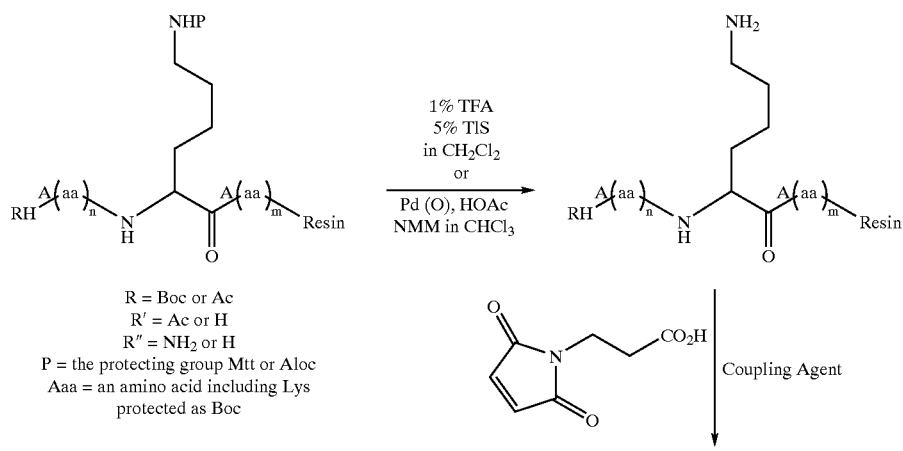

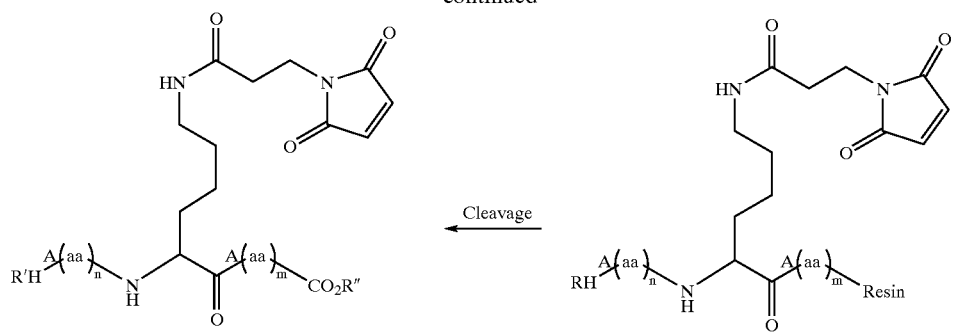

If an N-terminus modification is favored, and again for a peptide containing no cysteine, addition on the N terminus is performed with all residues still on the support resin and fully protected. Addition of activated NHS-Mal bifunctional linker could be performed on deprotected N-terminus with peptide still on resin. The peptide is then fully deprotected. Examples of therapeutic peptides that contain no cystein and undergo a C-terminus modification are described in examples 7–26. Examples of therapeutic peptides that contain no cystein and undergo a N-terminus modification are described in examples 27–38. The generalized reaction scheme for N-terminus modification of peptides that contain no cysteines is illustrated in the schematic diagrams below, using hetero NHS maleimide (GMBS like) and 3-MPA, respectively.

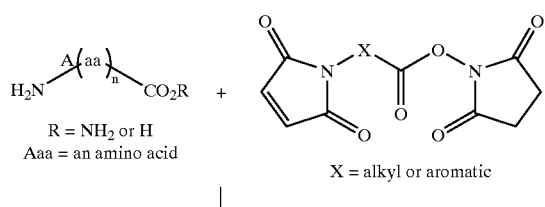

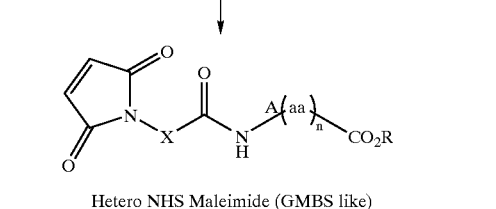

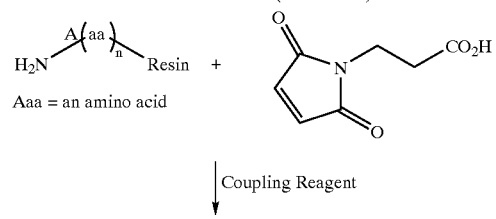

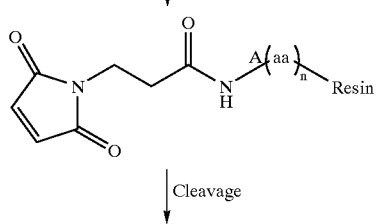

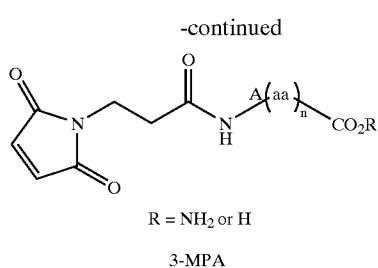

3-MPA

Alternatively, the peptide may be modified at an internal amino acid (i.e. neither at the C-terminus nor at the N-terminus). The generalized reaction scheme for modification at an internal amino acid of a peptide that contains no free cysteines is illustrated in the schematic diagrams below, using homo bis NHS and hetero NHS maleimide.

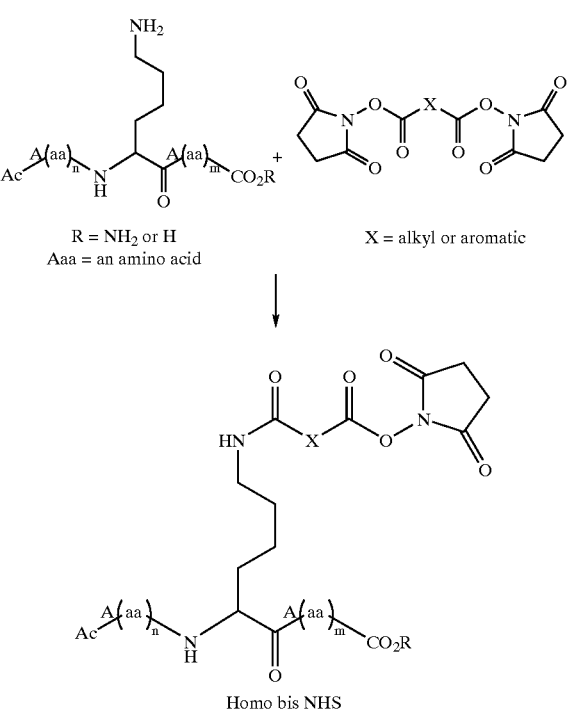

Homo bis NHS

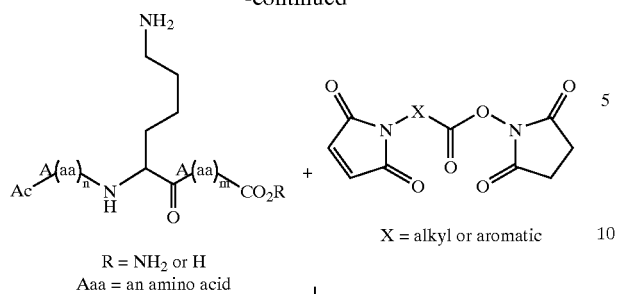

R = NH₂ or H
Aaa = an amino acid

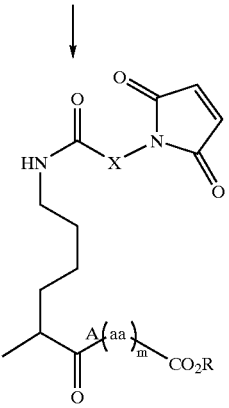

Hetero NHS Maleimide (GMBS like)

Peptides that contain no cysteine and can be modified as described above include fragments of the Kringle 5 peptide, of the GLP-1 peptide, of dynorphin A, human growth hormone releasing factor, the 1–24 fragment of human neuropeptide Y, and human secretin. Full description of the chemistry for each of these peptides is reported in the Example section.

B. Peptides that Contain One Cysteine

Where the peptide contains one cysteine, the cysteine must stay capped after addition of the maleimide. If the cysteine is involved in binding site, assessment has to be made of how much potency is lost is cysteine is capped by a protecting group. If the cysteine can stay capped, then the synthetic path is similar to that described in section A above for either a C or an N terminus modification.

Alternatively, the peptide may be modified at an internal amino acid (i.e. neither at the C-terminus nor at the N-terminus). The generalized reaction scheme for modification at an internal amino acid of a peptide that contains no cysteines is illustrated in the schematic diagram below, using homobis maleimide and hetero NHS maleimide (GMBS like).

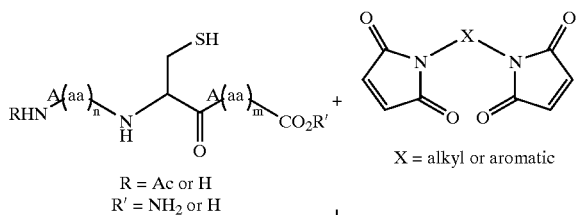

R = Ac or H
R' = NH₂ or H
Aaa = an amino acid

X = alkyl or aromatic

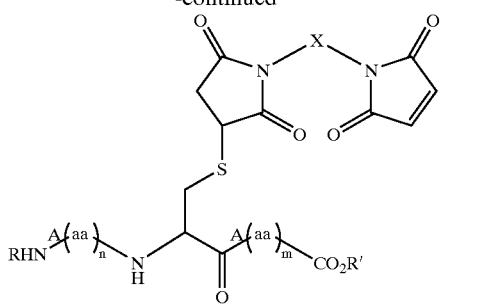

Homobis Maleimide

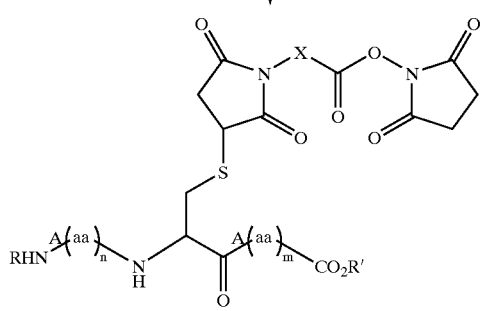

Hetero NHS Maleimide (GMBS like)

Examples of therapeutic peptides that contain one cysteine include $G_\alpha$ (the alpha subunit of Gtherapeutic peptide binding protein), the 724–739 fragment of rat brain nitric oxide synthase blocking peptide, the alpha subunit 1–32 fragment of human [Tyr0] inhibin, the 254–274 fragment of HIV envelope protein, and P34cdc2 kinase fragment.

C. Peptides that Contain Two Cysteines as a Disulfide Bridge (Cystine)

Where the peptide contains two cysteines as a disulfide bridge, the peptide is cleaved from the support resin before addition of the maleimide. For a modification of the peptide from the C terminus end, all protecting groups are present except at the carboxy terminus (which stays unprotected due to cleavage from the support resin) and at the two cysteines, which need to be deprotected when peptide is cleaved from resin. Mild air oxidation yields the disulfide bridge, and the peptide can be purified at that stage. Solution phase chemistry is then required to activate the C-terminus in presence of the disulfide bridge and add the maleimide (through an amino-alkyl-maleimide) to the C-terminus. The peptide is then fully deprotected.

For a modification of the peptide at the N-terminus, the peptide can remain on the support resin. The two cysteines are selectively deprotected before addition of the maleimide. Air oxidation, potentially helped by a catalyst (heterogeneous) can yield the disulfide with the peptide still on the resin. Maleimide is then added on the N-terminus and peptide cleaved from resin and fully deprotected. The generalized reaction scheme for modification at an internal amino acid of a peptide that contains two cysteines in a disulfide bridge is illustrated in the schematic diagram below.

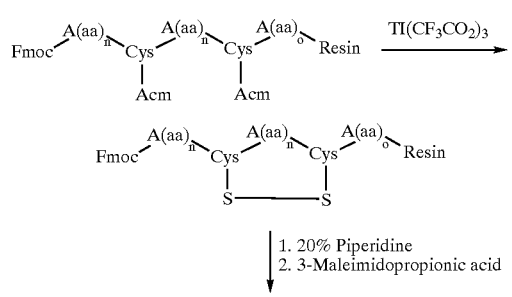

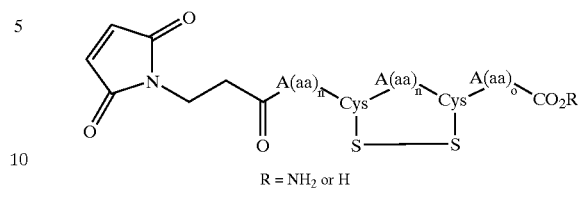

1. 20% Piperidine
2. 3-Maleimidopropionic acid

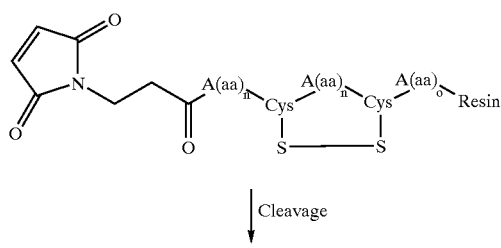

Cleavage

R = NH$_2$ or H

Alternatively, the peptide may be modified at an internal amino acid (i.e. neither at the C-terminus nor at the N-terminus). The generalized reaction scheme for modification at an internal amino acid of a peptide that contains two cysteines in a disulfide bridge is illustrated in the schematic diagram below.

Peptide Scheme 10

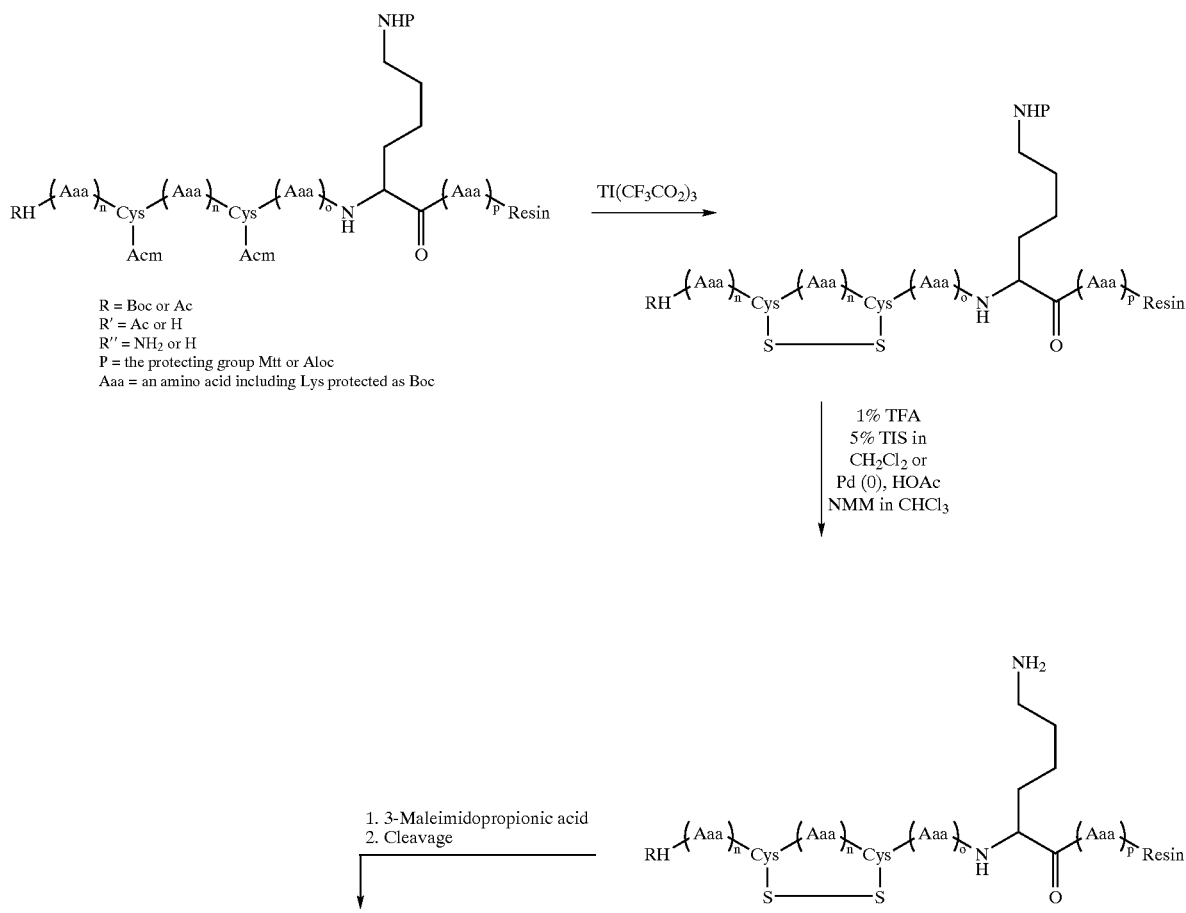

-continued

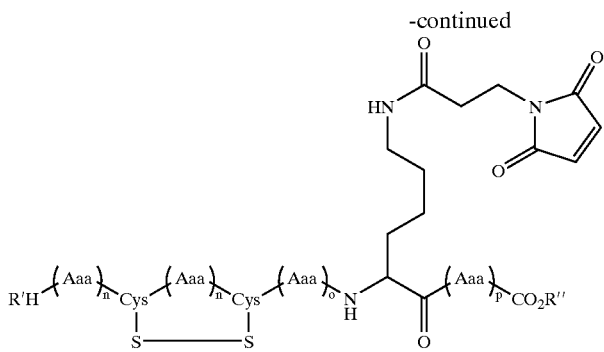

Examples of therapeutic peptides that contain two cysteines as a disulfide bridge include human osteocalcin 1–49, human diabetes associated peptide, the 5–28 fragment of human/canine atrial natriuretic peptide, bovine bactenecin, and human [Tyr0]-cortistatin 29.

D. Peptides Containing Multiple Cysteines

Where the peptide contains multiple cysteines as disulfide bridges, the peptide is cleaved from the support resin before addition of the maleimide. For a modification of the peptide from the C terminus end, all protecting groups are present except at the carboxy terminus (which stays unprotected due to cleavage from the support resin) and at the two cysteines that are supposed to build a disulfide bridge. Cysteines that are involved in other disulfide bridges are deprotected sequencially in pairs using a choice of protecting groups. It is recommended to build and purify each bridge one at a time prior to moving on to the next bridge. Mild air oxidation yields the disulfide bridge, and the peptide should be purified at each stage. Solution phase chemistry is then required to activate the C-terminus in presence of the disulfide bridge and add the maleimide (through an aminoalkyl-maleimide) to the C-terminus. The peptide is then fully deprotected.

For a modification of the peptide from the N terminus end, one can leave the peptide on the support resin and selectively deprotect the first two cysteines to build the disulfide under mild air oxidation. Subsequent deprotection will offer the other disulfides before addition of the maleimide. Air oxidation, potentially helped by a catalyst (heterogeneous) can yield the disulfides with the peptide still on the resin. Maleimide is then added on the N-terminus and peptide cleaved from resin and fully deprotected.

Alternatively, the peptide may be modified at an internal amino acid (i.e. neither at the C-terminus nor at the N-terminus).

Peptides containing multiple cysteines include human endothelins and [Lys4] Sarafotoxin S6c.

5. Administration of the Modified Therapeutic Peptides

The modified therapeutic peptide will be administered in a physiologically acceptable medium, e.g. deionized water, phosphate buffered saline (PBS), saline, aqueous ethanol or other alcohol, plasma, proteinaceous solutions, mannitol, aqueous glucose, alcohol, vegetable oil, or the like. Other additives which may be included include buffers, where the media are generally buffered at a pH in the range of about 5 to 10, where the buffer will generally range in concentration from about 50 to 250 mM, salt, where the concentration of salt will generally range from about 5 to 500 mM, physiologically acceptable stabilizers, and the like. The compositions may be lyophilized for convenient storage and transport.

The modified Itherapeutic peptides will for the most part be administered orally, parenterally, such as intravascularly (IV), intraarterially (IA), intramuscularly (IM), subcutaneously (SC), or the like. Administration may in appropriate situations be by transfusion. In some instances, where reaction of the functional group is relatively slow, administration may be oral, nasal, rectal, transdermal or aerosol, where the nature of the conjugate allows for transfer to the vascular system. Usually a single injection will be employed although more than one injection may be used, if desired. The modified therapeutic peptides may be administered by any convenient means, including syringe, trocar, catheter, or the like. The particular manner of administration will vary depending upon the amount to be administered, whether a single bolus or continuous administration, or the like. Preferably, the administration will be intravascularly, where the site of introduction is not critical to this invention, preferably at a site where there is rapid blood flow, e.g., intravenously, peripheral or central vein. Other routes may find use where the administration is coupled with slow release techniques or a protective matrix. The intent is that the Itherapeutic peptides be effectively distributed in the blood, so as to be able to react with the blood components. The concentration of the conjugate will vary widely, generally ranging from about 1 pg/ml to 50 mg/ml. The total administered intravascularly will generally be in the range of about 0.1 mg/ml to about 10 mg/ml, more usually about 1 mg/ml to about 5 mg/ml.

By bonding to long-lived components of the blood, such as immunoglobulin, serum albumin, red blood cells and platelets, a number of advantages ensue. The activity of the modified therapeutic peptides compound is extended for days to weeks. Only one administration need be given during this period of time. Greater specificity can be achieved, since the active compound will be primarily bound to large molecules, where it is less likely to be taken up intracellularly to interfere with other physiological processes.

The formation of the covalent bond between the blood component may occur in vivo or ex vivo. For ex vivo covalent bond formation, the modified Itherapeutic peptide is added to blood, serum or saline solution containing human serum albumin or IgG to permit covalent bond formation between the modified therapeutic peptide and the blood component. In a preferred format, the therapeutic peptide is modified with maleimide and it is reacted with human serum albumin in saline solution. Once the modified therapeutic peptide has reacted with the blood component, to form a therapeutic peptide-protein conjugate, the conjugate may be administered to the patient.

Alternatively, the modified therapeutic peptide may be administered to the patient directly so that the covalent bond forms between the modified Itherapeutic peptide and the blood component in vivo.

In addition, where localized delivery of therapeutic peptides is desired, several methods of delivery may be used:

A. Open Surgical Field Lavage

There are a number of indications for local therapeutic compounds which would entail administration of the therapeutic compound as an adjunct to open surgery. In these cases, the therapeutic compound would either be lavaged in the surgical site (or a portion of that site) prior to closure, or the therapeutic compound would be incubated for a short time in a confined space (e.g., the interior of a section of an artery following an endarterectomy procedure or a portion of GI tract during resection) and the excess fluid subsequently evacuated.

B. Incubation of Tissue Grafts

Tissue grafts such as autologous and xenobiotic vein/artery and valve grafts as well as organ grafts can be pretreated with therapeutic compounds that have been modified to permit covalent bond formation by either incubating them in a therapeutic solution and/or perfusing them with such a solution.

C. Catheter Delivery

A catheter is used to deliver the therapeutic compound either as part of an endoscopic procedure into the interior of an organ (e.g., bladder, GI tract, vagina/uterus) or adjunctive to a cardiovascular catheter procedure such as a balloon angioplasty. Standard catheters as well as newer drug delivery and iontophoretic catheters can be utilized.

D. Direct Injection

For certain poorly vascularized spaces such as intraarticular joint spaces, a direct injection of a therapeutic compound may be able to bioconjugate to surface tissues and achieve a desirable duration of drug effect. Other applications could include intra medullary, intratumor, intravaginal, intrauterine, intra intestinal, intra eustachian tube, intrathecal, subcutaneous, intrarticular, intraperitoneal or intraocular injections as weel as via bronchoscope, via nasogastiric tube and via nophrostomy.

6. Monitoring the Presence of Modified Therapeutic Peptide Derivatives

Another aspect of this invention relates to methods for determining the concentration of the therapeutic peptides and/or analogs, or their derivatives and conjugates in biological samples (such as blood) and determining the peptidase stability of the modified peptides. The blood of the mammalian host may be monitored for the presence of the modified therapeutic peptide compounds one or more times. By taking a portion or sample of the blood of the host, one may determine whether the therapeutic peptide has become bound to the long-lived blood components in sufficient amount to be therapeutically active and, thereafter, the level of therapeutic peptide compound in the blood. If desired, one may also determine to which of the blood components the therapeutic peptide derivative molecule is bound. This is particularly important when using non-specific therapeutic peptides. For specific maleimide-therapeutic peptides, it is much simpler to calculate the half life of serum albumin and IgG.

One method for determining the concentration of the therapeutic peptide, analogs, derivatives and conjugates is to use antibodies specific to the therapeutic peptides or therapeutic peptide analogs or their derivatives and conjugates, and to use such antibodies as a treatment for toxicity potentially associated with such therapeutic peptides, analogs, and/or their derivatives or conjugates. This is advantageous because the increased stability and life of the therapeutic peptides in vivo in the patient might lead to novel problems during treatment, including increased possibility for toxicity. It should be mentioned, however, that in some cases, the traditional antibody assay may not recognize the difference between cleaved and uncleaved therapeutic peptides. In such cases, other assay techniques may be employed, for example LC/MS (Liquid Chromatography/Mass Spectrometry).

The use of antibodies, either monoclonal or polyclonal, having specificity for a particular therapeutic peptide, analog or derivative thereof, can assist in mediating any such problem. The antibody may be generated or derived from a host immunized with the particular therapeutic peptide, analog or derivative thereof, or with an immunogenic fragment of the agent, or a synthesized immunogen corresponding to an antigenic determinant of the agent. Preferred antibodies will have high specificity and affinity for native, derivatized and conjugated forms of the therapeutic peptide or therapeutic peptide analog. Such antibodies can also be labeled with enzymes, fluorochromes, or radiolabels.

Antibodies specific for derivatized therapeutic peptides may be produced by using purified therapeutic peptides for the induction of derivatized therapeutic peptide-specific antibodies. By induction of antibodies, it is intended not only the stimulation of an immune response by injection into animals, but analogous steps in the production of synthetic antibodies or other specific binding molecules such as screening of recombinant immunoglobulin libraries. Both monoclonal and polyclonal antibodies can be produced by procedures well known in the art. In some cases, the use of monoclonal antibodies may be preferred over polyclonal antibodies, such as when degradation occurs over an area not covered by epitope/antibody recognition.

The antibodies may be used to treat toxicity induced by administration of the therapeutic peptide, analog or derivative thereof, and may be used ex vivo or in vivo. Ex vivo methods would include immuno-dialysis treatment for toxicity employing antibodies fixed to solid supports. In vivo methods include administration of antibodies in amounts effective to induce clearance of antibody-agent complexes.

The antibodies may be used to remove the therapeutic peptides, analogs or derivatives thereof, and conjugates thereof, from a patient's blood ex vivo by contacting the blood with the antibodies under sterile conditions. For example, the antibodies can be fixed or otherwise immobilized on a column matrix and the patient's blood can be removed from the patient and passed over the matrix. The therapeutic peptide analogs, derivatives or conjugates, will bind to the antibodies and the blood containing a low concentration of the therapeutic peptide, analog, derivative or conjugate, then may be returned to the patient's circulatory system. The amount of therapeutic peptide compound removed can be controlled by adjusting the pressure and flow rate. Preferential removal of the therapeutic peptides, analogs, derivatives and conjugates from the plasma component of a patient's blood can be affected, for example, by the use of a semipermeable membrane, or by otherwise first separating the plasma component from the cellular component by ways known in the art prior to passing the plasma component over a matrix containing the anti-therapeutic antibodies. Alternatively the preferential removal of therapeutic peptide-conjugated blood cells, including red blood cells, can be effected by collecting and concentrating the blood cells in the patient's blood and contacting those cells with fixed anti-therapeutic antibodies to the exclusion of the serum component of the patient's blood.

The antibodies can be administered in vivo, parenterally, to a patient that has received the therapeutic peptide, analogs, derivatives or conjugates for treatment. The antibodies will bind the therapeutic peptide compounds and conjugates. Once bound the therapeutic peptide, activity will be hindered if not completely blocked thereby reducing the biologically effective concentration of therapeutic peptide compound in the patient's bloodstream and minimizing harmful side effects. In addition, the bound antibody-therapeutic peptide complex will facilitate clearance of the therapeutic peptide compounds and conjugates from the patient's blood stream.

The invention having been fully described is now exemplified by the following non-limiting examples.

EXAMPLES

A. General Method of Synthesis of a Modified Therapeutic Peptide

Solid phase peptide synthesis of the modified peptide on a 100 μmole scale was performed on a Symphony Peptide Synthesizer using Fmoc protected Rink Amide MBHA resin, Fmoc protected amino acids, O-benzotriazol-1-yl-N,N,N', N'-tetramethyl-uronium hexafluorophosphate (HBTU) in N,N-dimethylformamide (DMF) solution and activation with N-methyl morpholine (NMM), and piperidine deprotection of Fmoc groups (Step 1). The deprotection of the terminal Fmoc group is accomplished using 20% piperidine (Step 2) followed by either the coupling of 3-maleimidopropionic acid (3-MPA), the coupling of acetic acid or the coupling of one or multiple Fmoc-AEEA followed by the coupling of 3-MPA (Step 3). Resin cleavage and products isolation are performed using 86% TFA/5% TIS/5% $H_2O$/2% thioanisole and 2% phenol, followed by precipitation by dry-ice cold $Et_2O$ (Step 4). The products are purified by preparative reverse phase HPLC using a Varian (Rainin) preparative binary HPLC system using a Dynamax $C_{18}$, 60 Å, 8 μm, 21 mm×25 cm column equipped with a Dynamax $C_{18}$, 60 Å, 8 μm guard module, 21 mm×25 cm column and UV detector (Varian Dynamax UVD II) at λ 214 and 254 nm. The product should have >95% purity as determined by RP-HPLC mass spectrometry using a Hewlett Packard LCMS-1100 series spectrometer equipped with a diode array detector and using electro-spray ionization.

B. Alteration of the Native Peptide Chain

To facilitate modification of the peptide, one or more amino acid residues may be added to the peptide as described in examples 1 to 5, and/or one or more amino acid residues may be replaced with other amino acid residues. This alteration aids attachment of the reactive group.

Example 1

Addition of Lys at C-Terminus of Kringle-5

Preparation of NAc-Pro-Arg-Lys-Leu-Tyr-Asp-Tyr-Lys-$NH_2$.3TFA

Using automated peptide synthesis, the following protected amino acids were sequentially added to Rink Amide MBHA resin: Fmoc-Lys(Boc)-OH, Fmoc-Tyr(tBu)OH, Fmoc-Asp(OtBu)-OH, Fmoc-Tyr(tBu)OH, Fmoc-Leu-OH, Fmoc-Lys(Boc)-OH, Fmoc-Arg(Pbf)-OH, Fmoc-Pro-OH. Deblocking of the Fmoc group the the N-terminal of the resin-bound amino acid was performed with 20% piperidine in DMF for about 15–20 minutes. Coupling of the acetic acid was performed under conditions similar to amino acid coupling. Final cleavage from the resin was performed using cleavage mixture as described above. The product was isolated by precipitation and purified by preparative HPLC to afford the desired product as a white solid upon lyophilization.

Example 2

Addition of Lys at C-Terminus of Kringle-5

Preparation of NAc-Arg-Lys-Leu-Tyr-Asp-Tyr-Lys-$NH_2$.2TFA.3TFA

Using automated peptide synthesis, the following protected amino acids were sequentially added to Rink Amide MBHA resin: Fmoc-Lys(Boc)-OH, Fmoc-Tyr(tBu)OH, Fmoc-Asp(OtBu)-OH, Fmoc-Tyr(tBu)OH, Fmoc-Leu-OH, Fmoc-Lys(Boc)-OH, Fmoc-Arg(Pbf)-OH. Deblocking of the Fmoc group the the N-terminal of the resin-bound amino acid was performed with 20% piperidine in DMF for about 15–20 minutes. Coupling of the acetic acid was performed under conditions similar to amino acid coupling. Final cleavage from the resin was performed using cleavage mixture as described above. The product was isolated by precipitation and purified by preparative HPLC to afford the desired product as a white solid upon lyophilization.

Example 3

Addition of Lys at N-Terminus of Kringle-5

Preparation of NAc-Tyr-Thr-Thr-Asn-Pro-Arg-Lys-Leu-Tyr-Asp-Tyr-Lys-$NH_2$.3TFA

Using automated peptide synthesis, the following protected amino acids were sequentially added to Rink Amide MBHA resin: Fmoc-Lys(Boc)-OH, Fmoc-Tyr(tBu)OH, Fmoc-Asp(OtBu)-OH, Fmoc-Tyr(tBu)OH, Fmoc-Leu-OH, Fmoc-Lys(Boc)-OH, Fmoc-Arg(Pbf)-OH, Fmoc-Pro-OH, Fmoc-Asn(Trt)-OH, Fmoc-Thr(tBu)-OH, Fmoc-Thr(tBu)-OH, Fmoc-Tyr(tBu)OH. Deblocking of the Fmoc group the the N-terminal of the resin-bound amino acid was performed with 20% piperidine in DMF for about 15–20 minutes. Coupling of the acetic acid was performed under conditions similar to amino acid coupling. Final cleavage from the resin was performed using cleavage mixture as described above. The product was isolated by precipitation and purified by preparative HPLC to afford the desired product as a white solid upon lyophilization.

Example 4

Addition of Lys at N-Terminus of Kringle-5, Substitution of Cys with Ala at Position 524

Preparation of NAc-Arg-Asn-Pro-Asp-Gly-Asp-Val-Gly-Gly-Pro-Trp-Ala$^{524}$-Tyr-Thr-Thr-Asn-Pro-Arg-Lys-Leu-Tyr-Asp-Tyr-Lys-$NH_2$.4TFA Using automated peptide synthesis, the following protected amino acids were sequentially added to Rink Amide MBHA resin: Fmoc-Lys(Boc)-OH, Fmoc-Tyr(tBu)OH, Fmoc-Asp(OtBu)-OH, Fmoc-Tyr(tBu)OH, Fmoc-Leu-OH, Fmoc-Lys(Boc)-OH, Fmoc-Arg(Pbf)-OH, Fmoc-Pro-OH, Fmoc-Asn(Trt)-OH, Fmoc-Thr(tBu)-OH, Fmoc-Thr(tBu)-OH, Fmoc-Tyr(tBu)OH, Fmoc-Ala-OH, Fmoc-Trp-OH, Fmoc-Pro-OH, Fmoc-Gly-OH, Fmoc-Gly-OH, Fmoc-Val-OH, Fmoc-Asp(OtBu)-OH, Fmoc-Asp(OtBu)-OH, Fmoc-Pro-OH, Fmoc-Asn(Trt)-OH, Fmoc-Arg(Pbf)-OH. Deblocking of the Fmoc group the the N-terminal of the resin-bound amino acid was performed with 20% piperidine in DMF for about 15–20 minutes. Coupling of the acetic acid was performed under conditions similar to amino acid coupling. Final cleavage from the resin was performed using cleavage mixture as described above. The product was isolated by precipitation and purified by preparative HPLC to afford the desired product as a white solid upon lyophilization.

Example 5
Addition of Lys at N-Terminus of Kringle-5
Preparation of NAc-Arg-Asn-Pro-Asp-Gly-Asp-Val-Gly-Gly-Pro-Trp-Lys-NH$_2$.2TFA Using automated peptide synthesis, the following protected amino acids were sequentially added to Rink Amide MBHA resin: Fmoc-Lys(Boc)-OH, Fmoc-Trp-OH, Fmoc-Pro-OH, Fmoc-Gly-OH, Fmoc-Gly-OH, Fmoc-Asp(OtBu)-OH, Fmoc-Gly-OH, Fmoc-Val-OH, Fmoc-Asp(OtBu)-OH, Fmoc-Pro-OH, Fmoc-Asn(Trt)-OH, Fmoc-Arg(Pbf)-OH. Deblocking of the Fmoc group the the N-terminal of the resin-bound amino acid was performed with 20% piperidine in DMF for about 15–20 minutes. Coupling of the acetic acid was performed under conditions similar to amino acid coupling. Final cleavage from the resin was performed using cleavage mixture as described above. The product was isolated by precipitation and purified by preparative HPLC to afford the desired product as a white solid upon lyophilization.

Example 6
Preparation of D-Ala2 GLP-1 (7-46) Amide

Solid phase peptide synthesis of the GLP-1 analog on a 100 μmole scale is performed using manual solid-phase synthesis and a Symphony Peptide Synthesizer using Fmoc protected Rink Amide MBHA resin, Fmoc protected amino acids, O-benzotriazol-1-yl-N,N,N',N'-tetramethyl-uronium hexafluorophosphate (HBTU) in N,N-dimethylformamide (DMF) solution and activation with N-methyl morpholine (NMM), and piperidine deprotection of Fmoc groups (Step 1). Resin cleavage and product isolation is performed using 85% TFA/5% TIS/5% thioanisole and 5% phenol, followed by precipitation by dry-ice cold Et$_2$O (Step 2). The product is purified by preparative reversed phased HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm to afford the desired peptide in >95% purity, as determined by RP-HPLC. These steps are illustrated in the schematic diagram below.

Fmoc-Rink Amide MBHA Resin

Step 1 | SPPS

H$_2$N-HaEGTFTSDVSSYLEGQAAKEFIAWLVKGR-PS

Step 2 | 85% TFA/5% TIS/5% thioanisole/5% phenol

TFA   TFA TFA
•     •   •
H$_2$N-HaEGTFTSDVSSYLEGQAAKEFIAWLVKGR-NH$_2$
                                    •
                                    TFA

D-Ala$^2$GLP-1 (7-36)-NH$_2$

C. Preparation of Modified Peptides from Peptides Containing No Cysteines

Preparation of maleimido peptides from therapeutic peptides containing multiple protected functional groups and no Cysteine is exemplified by the synthesis of peptides as described below. The peptide may be modified at the N-terminus, the C-terminus, or at an amino acid located between the N-terminus and the C-terminus. The modified peptide is synthesized by linking off the N-terminus of the natural peptide sequence or by linking off the modified C-terminus of the natural peptide sequence. One or more additional amino acids may be added to the therapeutic peptide to facilitate attachment of the reactive group.

1. Modification of the Therapeutic Peptide at the C-Terminus

Example 7
Modification of RSV Peptide at the ε-Amino Group of the Added C-terminus Lysine Residue
Preparation of Val-Ile-Thr-Ile-Glu-Leu-Ser-Asn-Ile-Lys-Glu-Asn-Lys-Met-Asn-Gly-Ala-Lys-Val-Lys-Leu-Ile-Lys-Gln-Glu-Leu-Asp-Lys-Tyr-Lys-Asn-Ala-Val-Lys-(Nε-MPA)

Solid phase peptide synthesis of the DAC analog on a 100 μmole scale is performed using manual solid-phase synthesis, a Symphony Peptide Synthesizer and Fmoc protected Rink Amide MBHA. The following protected amino acids are sequentially added to resin: Fmoc-Lys(Aloc)-OH, Fmoc-Val-OH, Fmoc-Ala-OH, Fmoc-Asn(Trt)-OH, Fmoc-Lys(Boc)-OH, Fmoc-Tyr(tBu)-OH, Fmoc-Lys(Boc)-OH, Fmoc-Asp(tBu)-OH, Fmoc-Leu-OH, Fmoc-Glu(tBu)-OH, Fmoc-Gln(Trt)-OH, Fmoc-Lys(Boc)-OH, Fmoc-Ile-OH, Fmoc-Leu-OH, Fmoc-Lys(Boc)-OH, Fmoc-Val-OH, Fmoc-Lys(Boc)-OH, Fmoc-Ala-OH, Fmoc-Gly-OH, Fmoc-Asn(Trt)-OH, Fmoc-Met-OH, Fmoc-Lys(Boc)-OH, Fmoc-Asn(Trt)-OH, Fmoc-Glu(tBu)-OH, Fmoc-Lys(Boc)-OH, Fmoc-Ile-OH, Fmoc-Asn(Trt)-OH, Fmoc-Ser(tBu)-OH, Fmoc-Leu-OH, Fmoc-Glu(tBu)-OH, Fmoc-Ile-OH, Fmoc-Thr(tBu)-OH, Fmoc-Ile-OH, Fmoc-Val-OH. They are dissolved in N,N-dimethylformamide (DMF) and, according to the sequence, activated using O-benzotriazol-1-yl-N,N,N',N'-tetramethyl-uronium hexafluorophosphate (HBTU) and Diisopropylethylamine (DIEA). Removal of the Fmoc protecting group is achieved using a solution of 20% (V/V) piperidine in N,N-dimethylformamide (DMF) for 20 minutes (step 1). The selective deprotection of the Lys (Aloc) group is performed manually and accomplished by treating the resin with a solution of 3 eq of Pd(PPh3)4 dissolved in 5 mL of CHCl3:NMM:HOAc (18:1:0.5) for 2 h (Step 2). The resin is then washed with CHCl3 (6×5 mL), 20% HOAc in DCM (6×5 mL), DCM (6×5 mL), and DMF (6×5 mL). The synthesis is then re-automated for the addition of the 3-maleimidopropionic acid (Step 3). Between every coupling, the resin is washed 3 times with N,N-dimethylformamide (DMF) and 3 times with isopropanol. The peptide is cleaved from the resin using 85% TFA/5% TIS/5% thioanisole and 5% phenol, followed by precipitation by dry-ice cold Et2O (Step 4). The product is purified by preparative reverse phase HPLC using a Varian (Rainin) preparative binary HPLC system: gradient elution of 30–55% B (0.045% TFA in H2O (A) and 0.045% TFA in CH3CN (B)) over 180 min at 9.5 mL/min using a Phenomenex Luna 10μ phenyl-hexyl, 21 mm×25 cm column and UV detector (Varian Dynamax UVD II) at λ 214 and 254 nm to afford the desired DAC in >95% purity, as determined by RP-HPLC.

Example 8
Modification of Dyn A 1-13 at the ε-Amino Group of the Added C-terminus Lysine Residue—Synthesis of Dyn A 1-13(Nε-MPA)-NH$_2$ Tyr-Gly-Gly-Phe-Leu-Arg-Arg-Ile-Arg-Pro-Lys-Leu-Lys-(Nε-MPA)-NH$_2$ Solid phase peptide synthesis of a modified Dyn A 1-13 on a 100 μmole scale was performed using manual solid-phase synthesis, a Symphony Peptide Synthesizer and Fmoc protected Rink Amide MBHA. The following protected amino acids were sequentially added to resin: Fmoc-Lys(Aloc)-OH, Fmoc-Leu-OH, Fmoc-Lys(Boc)-OH, Fmoc-Pro-OH, Fmoc-Arg(Pbf)-OH, Fmoc-Ile-OH, Fmoc-Arg(Pbf)-OH, Fmoc-Arg(Pbf)-OH, Fmoc-Leu-OH, Fmoc-Phe-OH, Fmoc-Gly-OH, Fmoc-Gly-OH, Fmoc-Tyr(tBu)-OH. They were dissolved in N,N-dimethylformamide (DMF) and, according to the sequence, activated using O-benzotriazol-1-yl-N,N, N',N'-tetramethyl-uronium hexafluorophosphate (HBTU) and Diisopropylethylamine (DIEA). Removal of the Fmoc protecting group is achieved using a solution of 20% (V/V) piperidine in N,N-dimethylformamide (DMF) for 20 minutes (Step 1). The selective deprotection of the Lys (Aloc) group is performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin is then washed with CHCl$_3$ (6×5 mL), 20% HOAc in DCM (6×5 mL), DCM (6×5 mL), and DMF (6×5 mL). The synthesis is then re-automated for the addition of the 3-maleimidopropionic acid (Step 3). Between every coupling, the resin is washed 3 times with N,N-dimethylformamide (DMF) and 3 times with isopropanol. The peptide is cleaved from the resin using 85% TFA/5% TIS/5% thioanisole and 5% phenol, followed by precipitation by dry-ice cold Et$_2$O (Step 4). The product is purified by preparative reverse phase HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm to afford the desired DAC in >95% purity, as determined by RP-HPLC.

The structure of this product is

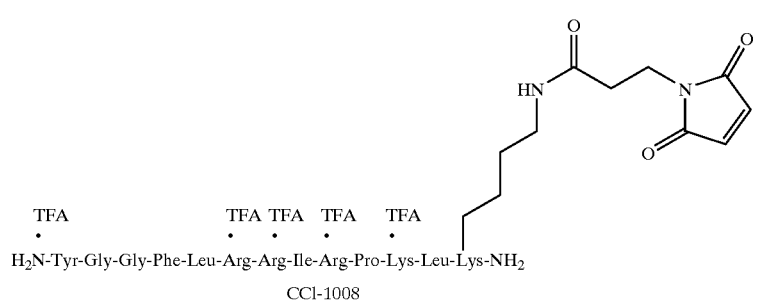

TFA  TFA TFA TFA  TFA
H$_2$N-Tyr-Gly-Gly-Phe-Leu-Arg-Arg-Ile-Arg-Pro-Lys-Leu-Lys-NH$_2$

CCI-1008

Example 9
Modification of Dyn A 2-13 at the ε-Amino Group of the Added C-terminus Lysine Residue—Synthesis of Dyn A 2-13(Nε-MPA)-NH$_2$ Gly-Gly-Phe-Leu-Arg-Arg-Ile-Arg-Pro-Lys-Leu-Lys-(Nε-MPA)-NH$_2$ Using automated peptide synthesis, the following protected amino acids were sequentially added to Rink Amide MBHA resin: Fmoc-Lys(Mtt)-OH, Fmoc-Leu-OH, Fmoc-Lys(Boc)-OH, Fmoc-Pro-OH, Fmoc-Arg(Pbf)-OH, Fmoc-Ile-OH, Fmoc-Arg(Pbf)-OH, Fmoc-Arg(Pbf)-OH, Fmoc-Leu-OH, Fmoc-Phe-OH, Fmoc-Gly-OH, and Boc-Gly-OH. Manual synthesis was employed for the remaining steps: selective removal of the Mtt group and coupling of MPA using HBTU/HOBt/DIEA activation in DMF. The target dynorphin analog was removed from the resin; the product was isolated by precipitation and purified by preparative HPLC to afford the desired product as a white solid upon lyophilization in a 35% yield. Anal. HPLC indicated product to be >95% pure with R$_t$=30.42 min. ESI-MS m/z for C$_{73}$H$_{123}$N$_{25}$O$_{15}$ (MH$^+$), calcd 1590.0, found MH$^{3+}$ 531.3.

Example 10
Modification of Dyn A 1-13 at the ε-Amino Group of the Added C-terminus Lysine Residue—Synthesis of Dyn A 1-13(AEA$_3$-MPA)-NH$_2$ Tyr-Gly-Gly-Phe-Leu-Arg-Arg-Ile-Arg-Pro-Lys-Leu-Lys-(AEA$_3$-MPA)-NH$_2$ Using automated peptide synthesis, the following protected amino acids were sequentially added to Rink Amide MBHA resin: Fmoc-Lys(Mtt)-OH, Fmoc-Leu-OH, Fmoc-Lys(Boc)-OH, Fmoc-Pro-OH, Fmoc-Arg(Pbf)-OH, Fmoc-Ile-OH, Fmoc-Arg(Pbf)-OH, Fmoc-Arg(Pbf)-OH, Fmoc-Leu-OH, Fmoc-Phe-OH, Fmoc-Gly-OH, Fmoc-Gly-OH, and Boc-Tyr(Boc)-OH. Manual synthesis was employed for the remaining steps: selective removal of the Mtt group, the coupling of three-Fmoc-AEA-OH groups (AEA= aminoethoxyacetic acid) with Fmoc removal in-between each coupling, and MPA acid using HBTU/HOBt/DIEA activation in DMF. The target dynorphin analog was removed from the resin; the product was isolated by precipitation and purified by preparative HPLC to afford the desired product as a white solid upon lyophilization in a 29% yield. Anal. HPLC indicated product to be >95% pure with R$_t$=33.06 min. ESI-MS m/z for C$_{94}$H$_{154}$N$_{29}$O$_{23}$ (MH$^+$), calcd 2057.2, found MH$^{4+}$ 515.4, MH$^{3+}$ 686.9, MH$^{2+}$ 1029.7.

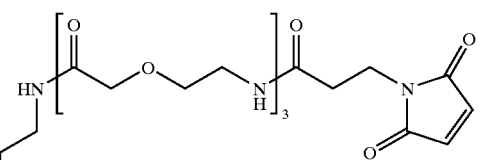
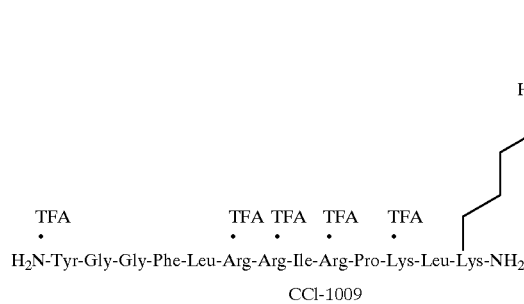

H$_2$N-Tyr-Gly-Gly-Phe-Leu-Arg-Arg-Ile-Arg-Pro-Lys-Leu-Lys-NH$_2$
with TFA markers at Tyr, Arg, Arg, Arg, Lys

CCI-1009

Example 11
Modification of Dyn A 2-13 at the ε-Amino Group of the Added C-terminus Lysine Residue—Synthesis of Dyn A 2-13(AEA$_3$-MPA)-NH$_2$ Gly-Gly-Phe-Leu-Arg-Arg-Ile-Arg-Pro-Lys-Leu-Lys-(AEA$_3$-MPA)-NH$_2$ Using automated peptide synthesis, the following protected amino acids were sequentially added to Rink Amide MBHA resin: Fmoc-Lys(Mtt)-OH, Fmoc-Leu-OH, Fmoc-Lys(Boc)-OH, Fmoc-Pro-OH, Fmoc-Arg(Pbf)-OH, Fmoc-Ile-OH, Fmoc-Arg(Pbf)-OH, Fmoc-Arg(Pbf)-OH, Fmoc-Leu-OH, Fmoc-Phe-OH, Fmoc-Gly-OH, and Fmoc-Gly-OH. Manual synthesis was employed for the remaining steps: selective removal of the Mtt group, the coupling of three-Fmoc-AEA-OH groups, with Fmoc removal in-between each coupling, and MPA using HBTU/HOBt/DIEA activation in DMF. The target dynorphin analog was removed from the resin; the product was isolated by precipitation and purified by preparative HPLC to afford the desired product as a white solid upon lyophilization in a 29% yield. Anal. HPLC indicated product to be >95% pure with R$_t$=31.88 min. ESI-MS m/z for C$_{85}$H$_{145}$N$_{25}$O$_{21}$ (MH$^+$), calcd 1894.3, found MH$^{4+}$ 474.6, MH$^{3+}$ 632.4, MH$^{2+}$ 948.10.

OH, Fmoc-Ala-OH, Fmoc-Asp(tBu)-OH, Fmoc-Glu(tBu)-OH, Fmoc-Gly-OH, Fmoc-Pro-OH, Fmoc-Asn(Trt)-OH, Fmoc-Asp(tBu)-OH, Fmoc-Pro-OH, Fmoc-Lys(Boc)-OH, Fmoc-Ser(tBu)-OH, Fmoc-Pro-OH, Fmoc-Tyr(tBu)-OH. They are dissolved in N,N-dimethylformamide (DMF) and, according to the sequence, activated using O-benzotriazol-1-yl-N,N,N',N'-tetramethyl-uronium hexafluorophosphate (HBTU) and Diisopropylethylamine (DIEA). Removal of the Fmoc protecting group is achieved using a solution of 20% (V/V) piperidine in N,N-dimethylformamide (DMF) for 20 minutes (Step 1). The selective deprotection of the Lys (Aloc) group is performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin is then washed with CHCl$_3$ (6×5 mL), 20% HOAc in DCM (6×5 mL), DCM (6×5 mL), and DMF (6×5 mL). The synthesis is then re-automated for the addition of the 3-maleimidopropionic acid (Step 3). Between every coupling, the resin is washed 3 times with N,N-dimethylformamide (DMF) and 3 times with isopropanol. The peptide is cleaved from the resin using 85% TFA/5% TIS/5% thioanisole and 5% phenol, followed by precipitation by dry-ice cold Et$_2$O (Step 4). The product is purified by

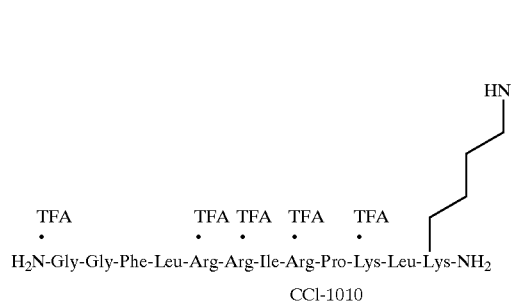

H$_2$N-Gly-Gly-Phe-Leu-Arg-Arg-Ile-Arg-Pro-Lys-Leu-Lys-NH$_2$
with TFA markers

CCI-1010

Example 12
Modification of Neuropeptide Y at the ε-Amino Group of the Added C-terminus Lysine Residue
Preparation of Tyr-Pro-Ser-Lys-Pro-Asp-Asn-Pro-Gly-Glu-Asp-Ala-Pro-Ala-Glu-Asp-Met-Ala-Arg-Tyr-Tyr-Ser-Ala-Leu-Lys-(N-εMPA)-NH$_2$ Solid phase peptide synthesis of a modified neuropeptide Y analog on a 100 μmole scale is performed using manual solid-phase synthesis, a Symphony Peptide Synthesizer and Fmoc protected Rink Amide MBHA. The following protected amino acids were sequentially added to resin: Fmoc-Lys(Aloc)-OH, Fmoc-Leu-OH, Fmoc-Ala-OH, Fmoc-Ser(tBu)-OH, Fmoc-Tyr(tBu)-OH, Fmoc-Tyr(tBu)-OH, Fmoc-Arg(Pbf)-OH, Fmoc-Ala-OH, Fmoc-Met-OH, Fmoc-Asp(tBu)-OH, Fmoc-Glu(tBu)-OH, Fmoc-Ala-OH, Fmoc-Propreparative reverse phase HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm to afford the desired DAC in >95% purity, as determined by RP-HPLC.

Example 13
Modification of GLP-1 (7-36) at the C-Terminus Arginine
Preparation of GLP-1 (7-36)-EDA-MPA Solid phase peptide synthesis of a modified GLP-1 analog on a 100 μmole scale is performed manually and on a Symphony Peptide Synthesizer SASRIN (super acid sensitive resin). The following protected amino acids are sequentially added to the resin: Fmoc-Arg(Pbf)-OH, Fmoc-Gly-OH, Fmoc-Lys(Boc)-OH, Fmoc-Val-OH, Fmoc-Leu-OH, Fmoc-Trp(Boc)-OH, Fmoc-Ala-OH, Fmoc-Ile-OH, Fmoc-Phe-OH, Fmoc-Glu(OtBu)-OH, Fmoc-Lys(Boc)-OH, Fmoc-Ala-OH, Fmoc-Ala-OH, Fmoc-Gln(Trt)-OH, Fmoc-Gly-OH, Fmco-Glu(OtBu)-OH, Fmoc-Leu-OH, Fmoc-Tyr(tBu)-OH, Fmoc-Ser(tBu)-OH, Fmoc-Ser(tBu)-OH, Fmoc-Val-OH, Fmoc-Asp(tBu)-OH, Fmoc-Ser(tBu)-OH, Fmoc-Thr(tBu)-OH, Fmoc-Phe-OH, Fmoc-Thr(tBu)-OH, Fmoc-Gly-OH, Fmoc-Glu(OtBu)-OH, Fmoc-Ala-OH, Boc-His(Trt)-OH. They are dissolved in N,N-dimethylformamide (DMF) and, according to the sequence, activated using O-benzotriazol-1-yl-N,N,N',N'-tetramethyl-uronium hexafluorophosphate (HBTU) and Diisopropylethylamine (DIEA). Removal of the Fmoc protecting group is achieved using a solution of 20% (V/V) piperidine in N,N-dimethylformamide (DMF) for 20 minutes (Step 1). The fully protected peptide is cleaved from the resin by treatment with 1% TFA/DCM (Step 2). Ethylenediamine and 3-maleimidopropionic acid are then sequentially added to the free C-terminus (Step 3). The protecting groups are then cleaved and the product isolated using 86% TFA/5% TIS/5% H$_2$O/2% thioanisole and 2% phenol, followed by precipitation by dry-ice cold Et$_2$O (Step 4). The product is purified by preparative reverse phase HPLC using a Varian (Rainin) preparative binary HPLC system using a Dynamax C$_{18}$, 60 Å, 8 μm, 21 mm×25 cm column equipped with a Dynamax C$_{18}$, 60 Å, 8 μm guard module, 21 mm×25 cm column and UV detector (Varian Dynamax UVD II) at λ 214 and 254 nm to afford the desired DAC in >95% purity, as determined by RP-HPLC. These steps are illustrated in the schematic diagram below.

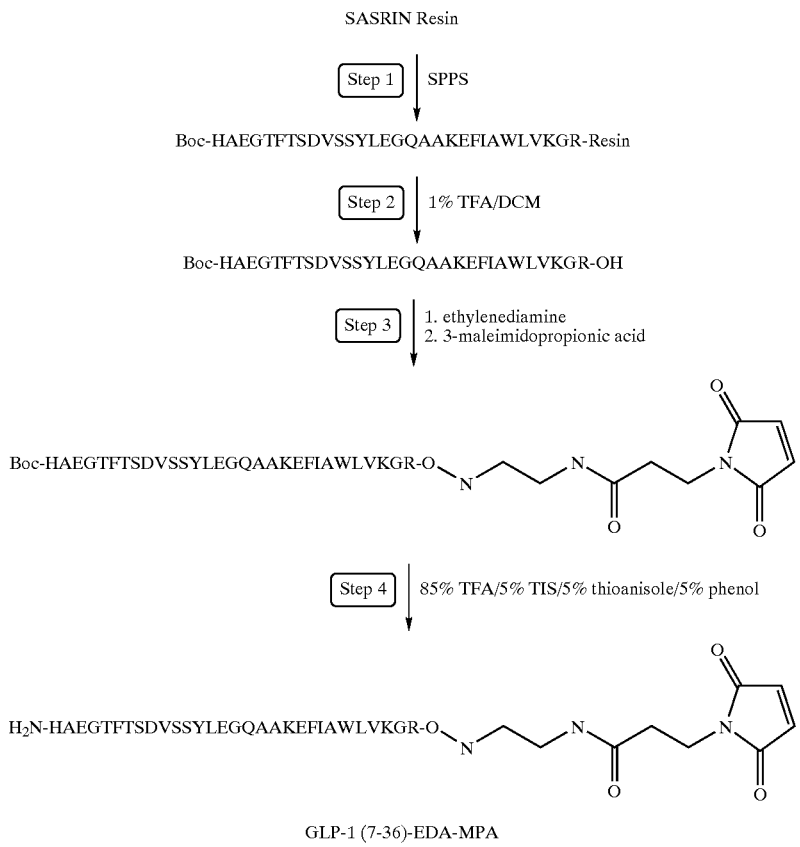

GLP-1 (7-36)-EDA-MPA

Example 14
Modification of Exendin-4 at the C-terminus Serine
Preparation of Exendin-4 (1-39)-EDA-MPA Solid phase peptide synthesis of a modified Exendin-4 analog on a 100 μmole scale is performed manually and on a Symphony Peptide Synthesizer SASRIN (super acid sensitive resin). The following protected amino acids are sequentially added to the resin: Fmoc-Ser(tBu)-OH, Fmoc-Pro-OH, Fmoc-Pro-OH, Fmoc-Pro-OH, Fmoc-Ala-OH, Fmoc-Gly-OH, Fmoc-Ser(tBu)-OH, Fmoc-Ser(tBu)-OH, Fmoc-Pro-OH, Fmoc-Gly-OH, Fmoc-Gly-OH, Fmoc-Asn(Trt)-OH, Fmoc-Lys(Boc)-OH, Fmoc-Leu-OH, Fmoc-Trp(Boc)-OH, Fmoc-Glu(OtBu)-OH, Fmoc-Ile-OH, Fmoc-Phe-OH, Fmoc-Leu-OH, Fmoc-Arg(Pbf)-OH, Fmoc-Val-OH, Fmoc-Ala-OH, Fmoc-Glu(OtBu)-OH, Fmoc-Glu(OtBu)-OH, Fmoc-Glu(OtBu)-OH, Fmoc-Met-OH, Fmoc-Gln(Trt)-OH, Fmoc-Lys(Boc)-OH, Fmoc-Ser(tBu)-OH, Fmoc-Leu-OH, Fmoc-Asp(OtBu)-OH, Fmoc-Ser(tBu)-OH, Fmoc-Thr(tBu)-OH, Fmoc-Phe-OH, Fmoc-Thr(tBu)-OH, Fmoc-Gly-OH, Fmoc-Glu(OtBu)-OH, Fmoc-Gly-OH, Boc-His(Trt)-OH. They are dissolved in N,N-dimethylformamide (DMF) and, according to the sequence, activated using O-benzotriazol-1-yl-N,N,N',N'-tetramethyluronium hexafluorophosphate (HBTU) and Diisopropylethylamine (DIEA). Removal of the Fmoc protecting group is achieved using a solution of 20% (V/V) piperidine in N,N-dimethylformamide (DMF) for 20 minutes (Step 1). The fully protected peptide is cleaved from the resin by treatment with 1% TFA/DCM (Step 2). Ethylenediamine and 3-maleimidopropionic acid are then sequentially added to the free C-terminus (Step 3). The protecting groups are then cleaved and the product isolated using 86% TFA/5% TIS/5% H₂O/2% thioanisole and 2% phenol, followed by precipitation by dry-ice cold Et₂O (Step 4). The product is purified by preparative reverse phase HPLC using a Varian (Rainin) preparative binary HPLC system using a Dynamax C$_{18}$, 60 Å, 8 µm, 21 mm×25 cm column equipped with a Dynamax C$_{18}$, 60 Å, 8 µm guard module, 21 mm×25 cm column and UV detector (Varian Dynamax UVD II) at λ 214 and 254 nm to afford the desired DAC in >95% purity, as determined by RP-HPLC.

(tBu)-OH, Fmoc-Phe-OH, Fmoc-Thr(tBu)-OH, Fmoc-Gly-OH, Fmoc-Asp(tBu)-OH, Fmoc-Ser(tBu)-OH, Fmoc-His(Boc)-OH. They are dissolved in N,N-dimethylformamide (DMF) and, according to the sequence, activated using O-benzotriazol-1-yl-N,N,N',N'-tetramethyl-uronium hexafluorophosphate (HBTU) and Diisopropylethylamine (DIEA). Removal of the Fmoc protecting group is achieved using a solution of 20% (V/V) piperidine in N,N-dimethylformamide (DMF) for 20 minutes (Step 1). The selective deprotection of the Lys (Aloc) group is performed manually and accomplished by treating the resin with a solution of 3 eq of Pd(PPh₃)₄ dissolved in 5 mL of

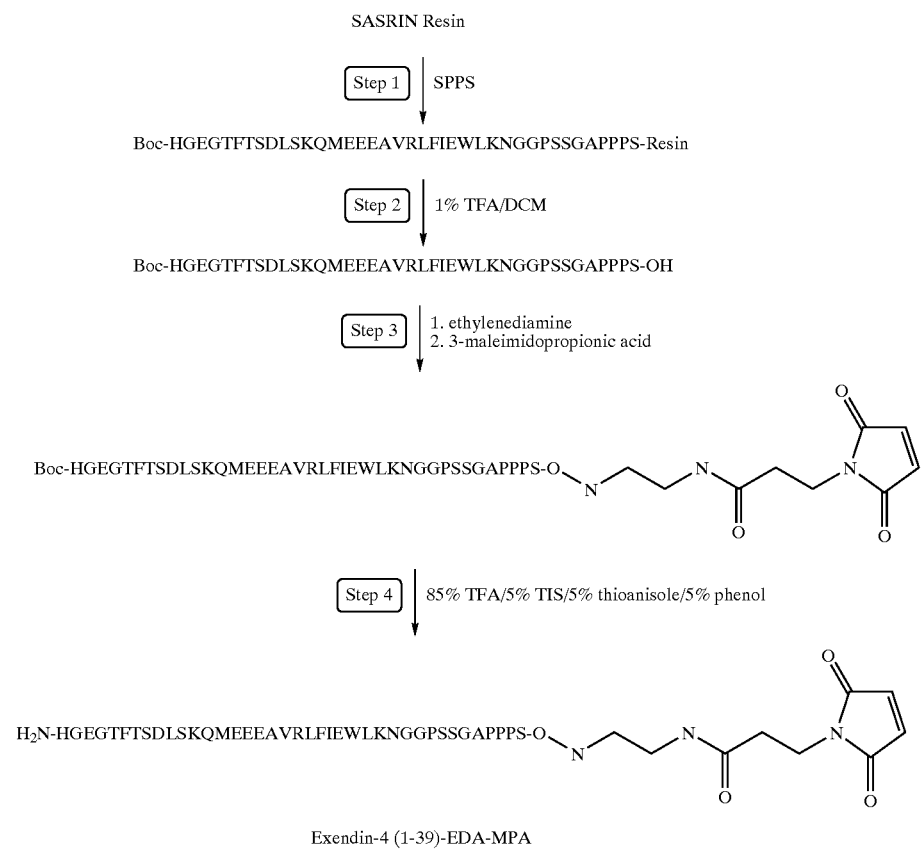

Exendin-4 (1-39)-EDA-MPA

Example 15

Modification of Secretin Peptide at the ε-Amino Group of the Added C-terminus Lysine Residue Preparation of His-Ser-Asp-Gly-Thr-Phe-Thr-Ser-Glu-Leu-Ser-Arg-Leu-Arg-Glu-Gly-Ala-Arg-Leu-Glu-Arg-Leu-Leu-Gln-Gly-Leu-Val-Lys-(Nε-MPA)-NH₂

Solid phase peptide synthesis of a modified secretin peptide analog on a 100 µmole scale is performed using manual solid-phase synthesis, a Symphony Peptide Synthesizer and Fmoc protected Rink Amide MBHA. The following protected amino acids are sequentially added to resin: Fmoc-Lys(Aloc)-OH, Fmoc-Val-OH, Fmoc-Leu-OH, Fmoc-Gly-OH, Fmoc-Gln(Trt)-OH, Fmoc-Leu-OH, Fmoc-Leu-OH, Fmoc-Arg(Pbf)-OH, Fmoc-Glu(tBu)-OH, Fmoc-Leu-OH, Fmoc-Arg(Pbf)-OH, Fmoc-Ala-OH, Fmoc-Gly-OH, Fmoc-Glu(tBu)-OH, Fmoc-Arg(Pbf)-OH, Fmoc-Leu-OH, Fmoc-Arg(Pbf)-OH, Fmoc-Ser(tBu)-OH, Fmoc-Leu-OH, Fmoc-Glu(tBu)-OH, Fmoc-Ser(tBu)-OH, Fmoc-Thr CHCl₃:NMM:HOAc (18:1:0.5) for 2 h (Step 2). The resin is then washed with CHCl₃ (6×5 mL), 20% HOAc in DCM (6×5 mL), DCM (6×5 mL), and DMF (6×5 mL). The synthesis is then re-automated for the addition of the 3-maleimidopropionic acid (Step 3). Between every coupling, the resin is washed 3 times with N,N-dimethylformamide (DMF) and 3 times with isopropanol. The peptide is cleaved from the resin using 85% TFA/5% TIS/5% thioanisole and 5% phenol, followed by precipitation by dry-ice cold Et₂O (Step 4). The product is purified by preparative reverse phase HPLC using a Varian (Rainin) preparative binary HPLC system: gradient elution of 30–55% B (0.045% TFA in H₂O (A) and 0.045% TFA in CH₃CN (B)) over 180 min at 9.5 mL/min using a Phenomenex Luna 10µ phenyl-hexyl, 21 mm×25 cm column and UV detector (Varian Dynamax UVD II) at λ 214 and 254 nm to afford the desired DAC in >95% purity, as determined by RP-HPLC.

Example 16
Modification of Kringle-5 at the ε-Amino Group of the Added C-terminus Lysine Residue
Preparation of NAc-Pro-Arg-Lys-Leu-Tyr-Asp-Tyr-Lys-(Nε-MPA)-NH$_2$.2TFA Solid phase peptide synthesis of a modified Kringle-5 peptide on a 100 μmole scale was performed using manual solid-phase synthesis, a Symphony Peptide Synthesizer and Fmoc protected Rink Amide MBHA. The following protected amino acids are sequentially added to resin: Fmoc-Lys(Aloc)-OH, Fmoc-Tyr(tBu)-OH, Fmoc-Asp(tBu)-OH, Fmoc-Tyr(tBu)-OH, Fmoc-Leu-OH, Fmoc-Lys(Boc)-OH, Fmoc-Arg(Pbf)-OH, Fmoc-Pro-OH. They were dissolved in N,N-dimethylformamide (DMF) and, according to the sequence, activated using O-benzotriazol-1-yl-N,N,N',N'-tetramethyl-uronium hexafluorophosphate (HBTU) and Diisopropylethylamine (DIEA). Removal of the Fmoc protecting group is achieved using a solution of 20% (V/V) piperidine in N,N-dimethylformamide (DMF) for 20 minutes (step 1). At the end of the synthesis Acetic Anhydride was added to acetylate the N-terminal. The selective deprotection of the Lys (Aloc) group is performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin is then washed with CHCl$_3$ (6×5 mL), 20% HOAc in DCM (6×5 mL), DCM (6×5 mL), and DMF (6×5 mL). The synthesis is then re-automated for the addition of the 3-maleimidopropionic acid (Step 3). Between every coupling, the resin is washed 3 times with N,N-dimethylformamide (DMF) and 3 times with isopropanol. The peptide is cleaved from the resin using 85% TFA/5% TIS/5% thioanisole and 5% phenol, followed by precipitation by dry-ice cold Et$_2$O (Step 4). The product is purified by preparative reverse phase HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm to afford the desired DAC in >95% purity, as determined by RP-HPLC.

Example 17
Modification of Kringle-5 at the ε-Amino Group of the Added C-terminus Lysine Residue
Preparation of NAc-Tyr-Thr-Thr-Asn-Pro-Arg-Lys-Leu-Tyr-Asp-Tyr-Lys-(Nε-MPA)-NH$_2$.2TFA Using automated peptide synthesis, the following protected amino acids were sequentially added to Rink Amide MBHA resin: Fmoc-Lys(Aloc)-OH, Fmoc-Tyr(tBu)-OH, Fmoc-Asp(OtBu)-OH, Fmoc-Tyr(tBu)OH, Fmoc-Leu-OH, Fmoc-Lys(Boc)-OH, Fmoc-Arg(Pbf)-OH, Fmoc-Pro-OH, Fmoc-Asn(Trt)-OH, Fmoc-Thr(tBu)-OH, Fmoc-Thr(tBu)-OH, Fmoc-Tyr(tBu)OH (step 1). Deblocking of the Fmoc group the the N-terminal of the resin-bound amino acid was performed with 20% piperidine in DMF for about 15–20 minutes. Final cleavage from the resin was performed using cleavage mixture as described above. The product was isolated by precipitation and purified by preparative HPLC to afford the desired product as a white solid upon lyophilization The selective deprotection of the Lys(Aloc) group was performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin was then washed with CHCl$_3$ (6×5 mL), 20% HOAc in DCM (6×5 mL), DCM (6×5 mL), and DMF (6×5 mL). The synthesis was then re-automated for the addition of the 3-maleimidopropionic acid (Step 3). Resin cleavage and product isolation was performed using 85% TFA/5% TIS/5% thioanisole and 5% phenol, followed by precipitation by dry-ice cold Et$_2$O (Step 4). The product was purified by preparative reversed phased HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm.

Example 18
Modification of Kringle-5 at the ε-Amino Group of the Added C-terminus Lysine Residue
Preparation of NAc-Arg-Asn-Pro-Asp-Gly-Asp-Val-Gly-Gly-Pro-Trp-Ala-Tyr-Thr-Thr-Asn-Pro-Arg-Lys-Leu-Tyr-Asp-Tyr-Lys-(Nε-MPA)-NH$_2$.3TFA Using automated peptide synthesis, the following protected amino acids were sequentially added to Rink Amide MBHA resin: Fmoc-Lys(Aloc)-OH, Fmoc-Tyr(tBu)OH, Fmoc-Asp(OtBu)-OH, Fmoc-Tyr(tBu)OH, Fmoc-Leu-OH, Fmoc-Lys(Boc)-OH, Fmoc-Arg(Pbf)-OH, Fmoc-Pro-OH, Fmoc-Asn(Trt)-OH, Fmoc-Thr(tBu)-OH, Fmoc-Thr(tBu)-OH, Fmoc-Tyr(tBu)OH, Fmoc-Ala-OH, Fmoc-Trp-OH, Fmoc-Pro-OH, Fmoc-Gly-OH, Fmoc-Gly-OH, Fmoc-Val-OH, Fmoc-Asp(OtBu)-OH, Fmoc-Gly-OH, Fmoc-Asp (OtBu)-OH, Fmoc-Pro-OH, Fmoc-Asn(Trt)-OH, Fmoc-Arg (Pbf)-OH (step 1). Deblocking of the Fmoc group the the N-terminal of the resin-bound amino acid was performed with 20% piperidine in DMF for about 15–20 minutes. Coupling of the acetic acid was performed under conditions similar to amino acid coupling. Final cleavage from the resin was performed using cleavage mixture as described above. The product was isolated by precipitation and purified by preparative HPLC to afford the desired product as a white solid upon lyophilization.

The selective deprotection of the Lys(Aloc) group was performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin was then washed with CHCl$_3$ (6×5 mL), 20% HOAc in DCM (6×5 mL), DCM (6×5 mL), and DMF (6×5 mL). The synthesis was then re-automated for the addition of the 3-maleimidopropionic acid (Step 3). Resin cleavage and product isolation was performed using 85% TFA/5% TIS/5% thioanisole and 5% phenol, followed by precipitation by dry-ice cold Et$_2$O (Step 4). The product was purified by preparative reversed phased HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm.

Example 19
Modification of Kringle-5 at the ε-Amino Group of the Added C-terminus Lysine Residue
Preparation of NAc-Arg-Asn-Pro-Asp-Gly-Asp-Val-Gly-Gly-Pro-Trp-Lys-(Nε-MPA)-NH$_2$.TFA Using automated peptide synthesis, the following protected amino acids were sequentially added to Rink Amide MBHA resin: Fmoc-Lys(Aloc)-OH, Fmoc-Trp-OH, Fmoc-Pro-OH, Fmoc-Gly-OH, Fmoc-Gly-OH, Fmoc-Val-OH, Fmoc-Asp(OtBu)-OH, Fmoc-Gly-OH, Fmoc-Asp(OtBu)-OH, Fmoc-Pro-OH, Fmoc-Asn(Trt)-OH, Fmoc-Arg(Pbf)-OH (Step 1). The selective deprotection of the Lys(Aloc) group was performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin was then washed with CHCl$_3$ (6×5 mL), 20% HOAc in DCM (6×5 mL), DCM (6×5 mL), and DMF (6×5 mL). The synthesis was then re-automated for the addition of the 3-maleimidopropionic acid (Step 3). Resin cleavage and product isolation was performed using 85% TFA/5% TIS/5% thioanisole and 5% phenol, followed by precipitation by dry-ice cold Et$_2$O (Step 4). The product was purified by preparative reversed phased HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm.

Example 20

Modification of Kringle-5 at the ε-Amino Group of the Added C-terminus Lysine Residue
Preparation of NAc-Arg-Lys-Leu-Tyr-Asp-Tyr-Lys-(Nε-MPA)-NH$_2$.2TFA Using automated peptide synthesis, the following protected amino acids were sequentially added to Rink Amide MBHA resin: Fmoc-Lys(Aloc)-OH, Fmoc-Tyr(tBu)OH, Fmoc-Asp(OtBu)-OH, Fmoc-Tyr(tBu)OH, Fmoc-Leu-OH, Fmoc-Lys(Boc)-OH, Fmoc-Arg(Pbf)-OH (Step 1). Deblocking of the Fmoc group the N-terminal of the resin-bound amino acid was performed with 20% piperidine in DMF for about 15–20 minutes. Coupling of the acetic acid was performed under conditions similar to amino acid coupling. Final cleavage from the resin was performed using cleavage mixture as described above. The product was isolated by precipitation and purified by preparative HPLC to afford the desired product as a white solid upon lyophilization The selective deprotection of the Lys(Aloc) group was performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin was then washed with CHCl$_3$ (6×5 mL), 20% HOAc in DCM (6×5 mL), DCM (6×5 mL), and DMF (6×5 mL). The synthesis was then re-automated for the addition of the 3-maleimidopropionic acid (Step 3). Resin cleavage and product isolation was performed using 85% TFA/5% TIS/5% thioanisole and 5% phenol, followed by precipitation by dry-ice cold Et$_2$O (Step 4). The product was purified by preparative reversed phased HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm.

Example 21

Modification of Kringle-5 at the ε-Amino Group of the Added C-terminus Lysine Residue
Preparation of NAc-Pro-Arg-Lys-Leu-Tyr-Asp-Lys-(Nε-MPA)-NH$_2$.2TFA Using automated peptide synthesis, the following protected amino acids were sequentially added to Rink Amide MBHA resin: Fmoc-Lys(Aloc)-OH, Fmoc-Asp(OtBu)-OH, Fmoc-Tyr(tBu)OH, Fmoc-Leu-OH, Fmoc-Lys(Boc)-OH, Fmoc-Arg(Pbf)-OH, Fmoc-Pro-OH (Step 1). Deblocking of the Fmoc group the N-terminal of the resin-bound amino acid was performed with 20% piperidine in DMF for about 15–20 minutes. Coupling of the acetic acid was performed under conditions similar to amino acid coupling. Final cleavage from the resin was performed using cleavage mixture as described above. The product was isolated by precipitation and purified by preparative HPLC to afford the desired product as a white solid upon lyophilization The selective deprotection of the Lys(Aloc) group was performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin was then washed with CHCl$_3$ (6×5 mL), 20% HOAc in DCM (6×5 mL), DCM (6×5 mL), and DMF (6×5 mL). The synthesis was then re-automated for the addition of the 3-maleimidopropionic acid (Step 3). Resin cleavage and product isolation was performed using 85% TFA/5% TIS/5% thioanisole and 5% phenol, followed by precipitation by dry-ice cold Et$_2$O (Step 4). The product was purified by preparative reversed phased HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm.

Example 22

Modification of Kringle-5 at the ε-Amino Group of the Added C-terminus Lysine Residue
Preparation of NAc-Pro-Arg-Lys-Leu-Tyr-Asp-Tyr-Lys-(Nε-AEEA-MPA)-NH$_2$.2TFA Using automated peptide synthesis, the following protected amino acids were sequentially added to Rink Amide MBHA resin: Fmoc-Lys(Aloc)-OH, Fmoc-Tyr(tBu)OH, Fmoc-Asp(OtBu)-OH, Fmoc-Tyr(tBu)OH, Fmoc-Leu-OH, Fmoc-Lys(Boc)-OH, Fmoc-Arg(Pbf)-OH, Fmoc-Pro-OH (Step 1). Deblocking of the Fmoc group at the N-terminal of the resin-bound amino acid was performed with 20% piperidine in DMF for about 15–20 minutes. Coupling of the acetic acid was performed under conditions similar to amino acid coupling. The selective deprotection of the Lys(Aloc) group was performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin was then washed with CHCl$_3$ (6×5 mL), 20% HOAc in DCM (6×5 mL), DCM (6×5 mL), and DMF (6×5 mL). The synthesis was then re-automated for the addition. The synthesis was then re-automated for the addition of the AEEA (aminoethoxyethoxyacetic acid) group and of the 3-maleimidopropionic acid (MPA) (Step 3). Resin cleavage and product isolation was performed using 85% TFA/5% TIS/5% thioanisole and 5% phenol, followed by precipitation by dry-ice cold Et$_2$O (Step 4). The product was purified by preparative reversed phased HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm.

Example 23

Modification of Kringle-5 at the ε-Amino Group of the Added C-terminus Lysine Residue
Preparation of NAc-Pro-Arg-Lys-Leu-Tyr-Asp-Tyr-Lys-(Nε-AEEA$_n$-MPA)-NH$_2$.2TFA Using automated peptide synthesis, the following protected amino acids were sequentially added to Rink Amide MBHA resin: Fmoc-Lys(Aloc)-OH, Fmoc-Tyr(tBu)OH, Fmoc-Asp(OtBu)-OH, Fmoc-Tyr(tBu)OH, Fmoc-Leu-OH, Fmoc-Lys(Boc)-OH, Fmoc-Arg(Pbf)-OH, Fmoc-Pro-OH (Step 1). Deblocking of the Fmoc group at the N-terminal of the resin-bound amino acid was performed with 20% piperidine in DMF for about 15–20 minutes. Coupling of the acetic acid was performed under conditions similar to amino acid coupling.

The selective deprotection of the Lys(Aloc) group was performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin was then washed with CHCl₃ (6×5 mL), 20% HOAc in DCM (6×5 mL), DCM (6×5 mL), and DMF (6×5 mL). The synthesis was then re-automated for the addition. The synthesis was then re-automated for the addition of n AEEA (aminoethoxyethoxyacetic acid) groups and of the 3-maleimidopropionic acid (MPA) (Step 3). Resin cleavage and product isolation was performed using 85% TFA/5% TIS/5% thioanisole and 5% phenol, followed by precipitation by dry-ice cold Et₂O (Step 4). The product was purified by preparative reversed phased HPLC using a Varian (Rainin) preparative binary HPLC system: gradient elution of 30–55% B (0.045% TFA in H₂O (A) and 0.045% TFA in CH₃CN (B)) over 180 min at 9.5 mL/min using a Phenomenex Luna 10μ phenyl-hexyl, 21 mm×25 cm column and UV detector (Varian Dynamax UVD II) at λ 214 and 254 nm.

Example 24
Modification of GLP-1 at the ε-Amino Group of the Added C-terminus Lysine Residue
Preparation of GLP-1 (1-36)-Lys³⁷(Nε-MPA)-NH₂.5TFA; His-Asp-Glu-Phe-Glu-Arg-His-Ala-Glu-Gly-Thr-Phe-Thr-Ser-Asp-Val-Ser-Ser-Tyr-Leu-Glu-Gly-Gln-Ala-Ala-Lys-Glu-Phe-Ile-Ala-Trp-Leu-Val-Lys-Gly-Arg-Lys(Nε-MPA)-NH₂.5TFA Using automated peptide synthesis, the following protected amino acids were sequentially added to Rink Amide MBHA resin: Fmoc-Lys(Aloc)-OH, Fmoc-Arg(Pbf)-OH, Fmoc-Gly-OH, Fmoc-Lys(tBoc)-OH, Fmoc-Val-OH, Fmoc-Leu-OH, Fmoc-Trp-OH, Fmoc-Ala-OH, Fmoc-Ile-OH, Fmoc-Phe-OH, Fmoc-Glu(OtBu)-OH, Fmoc-Lys(tBoc)-OH, Fmoc-Ala-OH, Fmoc-Ala-OH, Fmoc-Gln(Trt)-OH, Fmoc-Gly-OH, Fmoc-Glu(OtBu)-OH, Fmoc-Leu-OH, Fmoc-Tyr(Pbf)-OH, Fmoc-Ser(tBu)-OH, Fmoc-Ser(tBu)-OH, Fmoc-Val-OH, Fmoc-Asp(OtBu)-OH, Fmoc-Ser(tBu)-OH, Fmoc-Thr(tBu)-OH, Fmoc-Phe-OH, Fmoc-Thr(tBu)-OH, Fmoc-Gly-OH, Fmoc-Glu(OtBu)-OH, Fmoc-Ala-OH, Boc-His(N-Trt)-OH, Fmoc-Arg(Pbf)-OH, Fmoc-Glu(OtBu)-OH, Fmoc-Phe-OH, Fmoc-Glu(OtBu)-OH, Fmoc-Asp(OtBu)-OH, Boc-His(N-Trt)-OH (step 1)

The selective deprotection of the Lys(Aloc) group was performed manually and accomplished by treating the resin with a solution of 3 eq of Pd(PPh₃)₄ dissolved in 5 mL of CHCl₃:NMM:HOAc (18:1:0.5) for 2 h (Step 2). The resin was then washed with CHCl₃ (6×5 mL), 20% HOAc in DCM (6×5 mL), DCM (6×5 mL), and DMF (6×5 mL). The synthesis was then re-automated for the addition of the 3-maleimidopropionic acid (Step 3). Resin cleavage and product isolation was performed using 85% TFA/5% TIS/5% thioanisole and 5% phenol, followed by precipitation by dry-ice cold Et₂O (Step 4). The product was purified by preparative reverse phase HPLC using a Varian (Rainin) preparative binary HPLC system: gradient elution of 30–55% B (0.045% TFA in H₂O (A) and 0.045% TFA in CH₃CN (B)) over 180 min at 9.5 mL/min using a Phenomenex Luna 10μ phenyl-hexyl, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro-spray ionization. These steps are illustrated in the schematic diagram below.

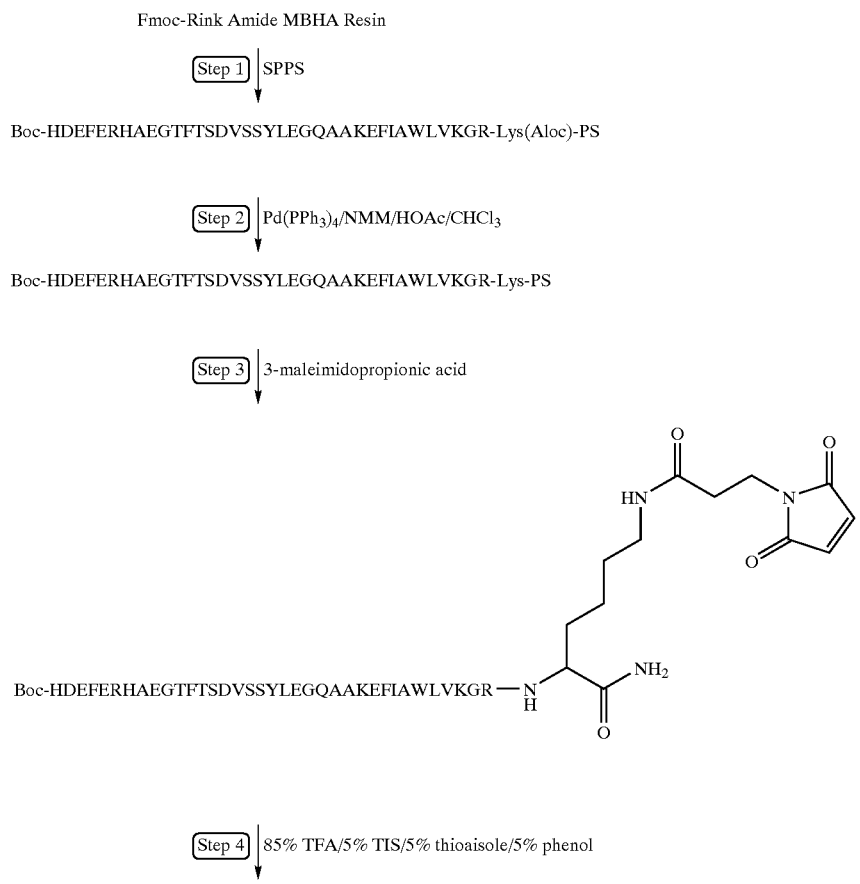

Fmoc-Rink Amide MBHA Resin

Step 1 | SPPS

Boc-HDEFERHAEGTFTSDVSSYLEGQAAKEFIAWLVKGR-Lys(Aloc)-PS

Step 2 | Pd(PPh₃)₄/NMM/HOAc/CHCl₃

Boc-HDEFERHAEGTFTSDVSSYLEGQAAKEFIAWLVKGR-Lys-PS

Step 3 | 3-maleimidopropionic acid

Step 4 | 85% TFA/5% TIS/5% thioaisole/5% phenol

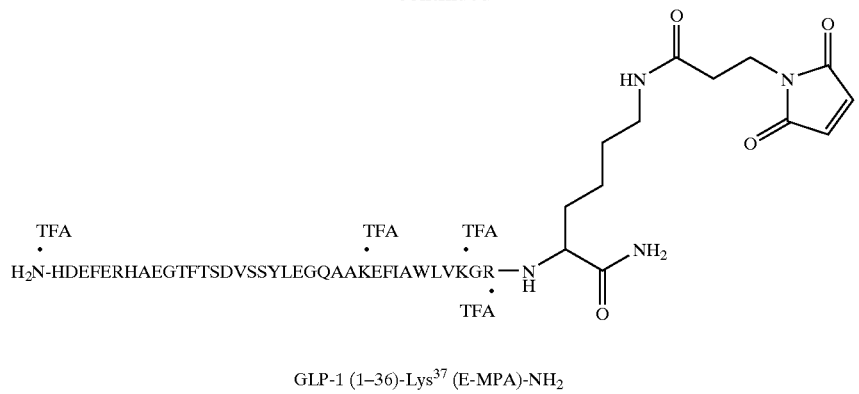

GLP-1 (1–36)-Lys³⁷ (E-MPA)-NH₂

Example 25
Modification of GLP-1 at the ε-Amino Group of the Added C-terminus Lysine Residue
Preparation of GLP-1 (1-36)-Lys$^{37}$(Nε-AEEA-AEEA-MPA)-NH$_2$.5TFA; His-Asp-Glu-Phe-Glu-Arg-His-Ala-Glu-Gly-Thr-Phe-Thr-Ser-Asp-Val-Ser-Ser-Tyr-Leu-Glu-Gly-Gln-Ala-Ala-Lys-Glu-Phe-Ile-Ala-Trp-Leu-Val-Lys-Gly-Arg-Lys(Nε-AEEA-AEEA-MPA)-NH$_2$.5TFA Using automated peptide synthesis, the following protected amino acids were sequentially added to Rink Amide MBHA resin: Fmoc-Lys(Aloc)-OH, Fmoc-Arg(Pbf)-OH, Fmoc-Gly-OH, Fmoc-Lys(tBoc)-OH, Fmoc-Val-OH, Fmoc-Leu-OH, Fmoc-Trp-OH, Fmoc-Ala-OH, Fmoc-Ile-OH, Fmoc-Phe-OH, Fmoc-Glu(OtBu)-OH, Fmoc-Lys(tBoc)-OH, Fmoc-Ala-OH, Fmoc-Ala-OH, Fmoc-Gln(Trt)-OH, Fmoc-Gly-OH, Fmoc-Glu(OtBu)-OH, Fmoc-Leu-OH, Fmoc-Tyr(Pbf)-OH, Fmoc-Ser(tBu)-OH, Fmoc-Ser(tBu)-OH, Fmoc-Val-OH, Fmoc-Asp(OtBu)-OH, Fmoc-Ser(tBu)-OH, Fmoc-Thr(tBu)-OH, Fmoc-Phe-OH, Fmoc-Thr(tBu)-OH, Fmoc-Gly-OH, Fmoc-Glu(OtBu)-OH, Fmoc-Ala-OH, Boc-His(N-Trt)-OH, Fmoc-Arg(Pbf)-OH, Fmoc-Glu(OtBu)-OH, Fmoc-Phe-OH, Fmoc-Glu(OtBu)-OH, Fmoc-Asp(OtBu)-OH, Boc-His(N-Trt)-OH (step 1).

The selective deprotection of the Lys(Aloc) group was performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin was then washed with CHCl$_3$ (6×5 mL), 20% HOAc in DCM (6×5 mL), DCM (6×5 mL), and DMF (6×5 mL). The synthesis was then re-automated for the addition of the two AEEA (aminoethoxyethoxyacetic acid) groups and the 3-maleimidopropionic acid (Step 3). Resin cleavage and product isolation was performed using 85% TFA/5% TIS/5% thioanisole and 5% phenol, followed by precipitation by dry-ice cold Et$_2$O (Step 4). The product was purified by preparative reverse phase HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro-spray ionization, ESI-MS m/z for C$_{174}$H$_{265}$N$_{44}$O$_{56}$ (MH$^+$), calcd 3868, found [M+H$_2$]$^{2+}$ 1934, [M+H$_3$]$^{3+}$ 1290, [M+H$_4$]$^{4+}$ 967. These steps are illustrated in the schematic diagram below.

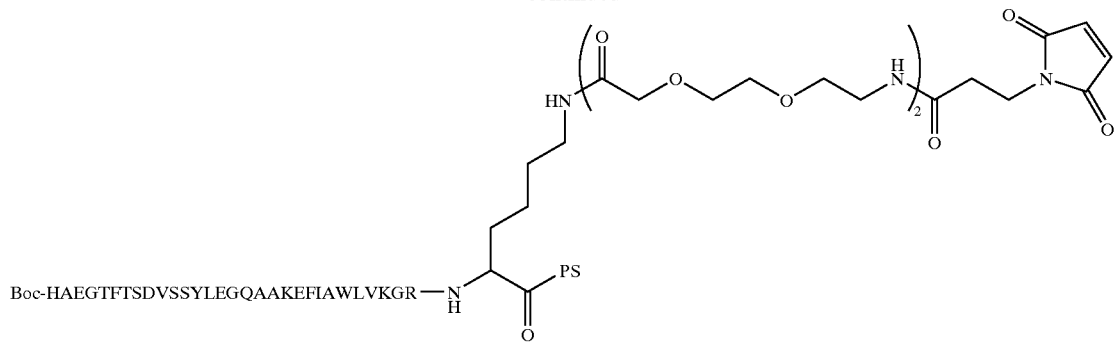

Boc-HAEGTFTSDVSSYLEGQAAKEFIAWLVKGR

Step 4 | 85% TFA/5% TIS/5% thioanisole/5% phenol

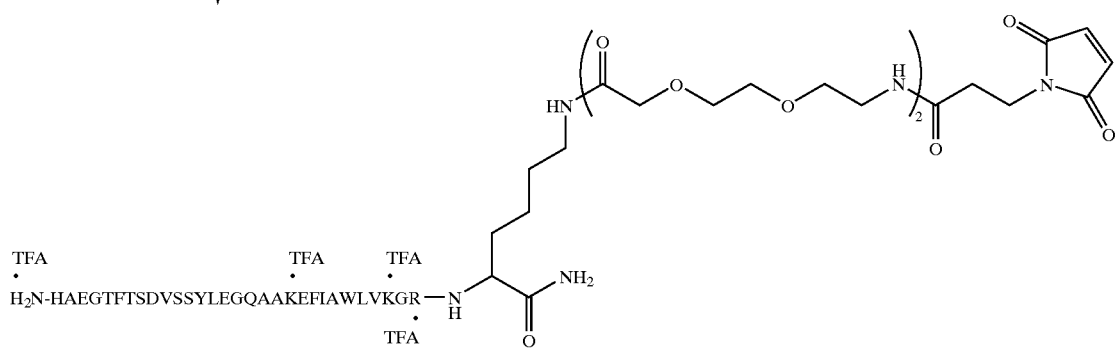

TFA · TFA · TFA
H₂N-HAEGTFTSDVSSYLEGQAAKEFIAWLVKGR
· TFA

CCI-1051
GLP-1 (7-36-K(AEEA₂-MPA))-NH₂

Example 26
Modification of GLP-1 at the ε-Amino Group of the Added C-terminus Lysine Residue
Preparation of GLP-1 (7-36)-Lys$^{37}$(Nε-MPA)-NH$_2$.4TFA; His-Ala-Glu-Gly-Thr-Phe-Thr-Ser-Asp-Val-Ser-Ser-Tyr-Leu-Glu-Gly-Gln-Ala-Ala-Lys-Glu-Phe-Ile-Ala-Trp-Leu-Val-Lys-Gly-Arg-Lys(Nε-MPA)-NH$_2$.4TFA Using automated peptide synthesis, the following protected amino acids were sequentially added to Rink Amide MBHA resin: Fmoc-Lys(Aloc)-OH, Fmoc-Arg(Pbf)-OH, Fmoc-Gly-OH, Fmoc-Lys(tBoc)-OH, Fmoc-Val-OH, Fmoc-Leu-OH, Fmoc-Trp-OH, Fmoc-Ala-OH, Fmoc-Ile-OH, Fmoc-Phe-OH, Fmoc-Glu(OtBu)-OH, Fmoc-Lys(tBoc)-OH, Fmoc-Ala-OH, Fmoc-Ala-OH, Fmoc-Gln(Trt)-OH, Fmoc-Gly-OH, Fmoc-Glu(OtBu)-OH, Fmoc-Leu-OH, Fmoc-Tyr(Pbf)-OH, Fmoc-Ser(tBu)-OH, Fmoc-Ser(tBu)-OH, Fmoc-Val-OH, Fmoc-Asp(OtBu)-OH, Fmoc-Ser(tBu)-OH, Fmoc-Thr(tBu)-OH, Fmoc-Phe-OH, Fmoc-Thr(tBu)-OH, Fmoc-Gly-OH, Fmoc-Glu(OtBu)-OH, Fmoc-Ala-OH, Boc-His(N-Trt)-OH (Step 1).

The selective deprotection of the Lys(Aloc) group was performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin was then washed with CHCl$_3$ (6×5 mL), 20% HOAc in DCM (6×5 mL), DCM (6×5 mL), and DMF (6×5 mL). The synthesis was then re-automated for the addition of the 3-maleimidopropionic acid (Step 3). Resin cleavage and product isolation was performed using 85% TFA/5% TIS/5% thioanisole and 5% phenol, followed by precipitation by dry-ice cold Et$_2$O (Step 4). The product was purified by preparative reverse phase HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro-spray ionization.

Example 27
Modification of GLP-1 at the ε-Amino Group of the Added C-terminus Lysine Residue
Preparation of GLP-1 (7-36)-Lys$^{37}$(Nε-AEEA-AEEA-MPA)-NH$_2$.4TFA His-Ala-Glu-Gly-Thr-Phe-Thr-Ser-Asp-Val-Ser-Ser-Tyr-Leu-Glu-Gly-Gln-Ala-Ala-Lys-Glu-Phe-Ile-Ala-Trp-Leu-Val-Lys-Gly-Arg-Lys(Nε-AEEA-AEEA-MPA)-NH$_2$.4TFA Using automated peptide synthesis, the following protected amino acids were sequentially added to Rink Amide MBHA resin: Fmoc-Lys(Aloc)-OH, Fmoc-Arg(Pbf)-OH, Fmoc-Gly-OH, Fmoc-Lys(tBoc)-OH, Fmoc-Val-OH, Fmoc- Leu-OH, Fmoc-Trp-OH, Fmoc-Ala-OH, Fmoc-Ile-OH, Fmoc-Phe-OH, Fmoc-Glu(OtBu)-OH, Fmoc-Lys(tBoc)-OH, Fmoc-Ala-OH, Fmoc-Ala-OH, Fmoc-Gln(Trt)-OH, Fmoc-Gly-OH, Fmoc-Glu(OtBu)-OH, Fmoc-Leu-OH, Fmoc-Tyr(Pbf)-OH, Fmoc-Ser(tBu)-OH, Fmoc-Ser(tBu)-OH, Fmoc-Val-OH, Fmoc-Asp(OtBu)-OH, Fmoc-Ser(tBu)-OH, Fmoc-Thr(tBu)-OH, Fmoc-Phe-OH, Fmoc-Thr(tBu)-OH, Fmoc-Gly-OH, Fmoc-Glu(OtBu)-OH, Fmoc-Ala-OH, Boc-His(N-Trt)-OH (Step 1).

The selective deprotection of the Lys(Aloc) group was performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin was then washed with CHCl$_3$ (6×5 mL), 20% HOAc in DCM (6×5 mL), DCM (6×5 mL), and DMF (6×5 mL). The synthesis was then re-automated for the addition of the two AEEA (aminoethoxyethoxyacetic acid) groups and the 3-maleimidopropionic acid (Step 3). Resin cleavage and product isolation was performed using 85% TFA/5% TIS/5% thioanisole and 5% phenol, followed by precipitation by dry-ice cold Et$_2$O (Step 4). The product was purified by preparative reverse phase HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10$\mu$ phenyl-hexyl, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro-spray ionization.

Example 28
Modification of D-Ala$^2$ GLP-1 at the ε-Amino Group of the Added C-terminus Lysine Residue
Preparation of D-Ala$^2$ GLP-1 (7-36)-Lys$^{37}$(Nε-MPA)-NH$_2$.4TFA His-d-Ala-Glu-Gly-Thr-Phe-Thr-Ser-Asp-Val-Ser-Ser-Tyr-Leu-Glu-Gly-Gln-Ala-Ala-Lys-Glu-Phe-Ile-Ala-Trp-Leu-Val-Lys-Gly-Arg-Lys(Nε-MPA)-NHh$_2$.4TFA Using automated peptide synthesis, the following protected amino acids were sequentially added to Rink Amide MBHA resin: Fmoc-Lys(Aloc)-OH, Fmoc-Arg(Pbf)-OH, Fmoc-Gly-OH, Fmoc-Lys(tBoc)-OH, Fmoc-Val-OH, Fmoc-Leu-OH, Fmoc-Trp-OH, Fmoc-Ala-OH, Fmoc-Ile-OH, Fmoc-Phe-OH, Fmoc-Glu(OtBu)-OH, Fmoc-Lys(tBoc)-OH, Fmoc-Ala-OH, Fmoc-Ala-OH, Fmoc-Gln(Trt)-OH, Fmoc-Gly-OH, Fmoc-Glu(OtBu)-OH, Fmoc-Leu-OH, Fmoc-Tyr(Pbf)-OH, Fmoc-Ser(tBu)-OH, Fmoc-Ser(tBu)-OH, Fmoc-Val-OH, Fmoc-Asp(OtBu)-OH, Fmoc-Ser(tBu)-OH, Fmoc-Thr(tBu)-OH, Fmoc-Phe-OH, Fmoc-Thr(tBu)-OH, Fmoc-Gly-OH, Fmoc-Glu(OtBu)-OH, Fmoc-d-Ala-OH, Boc-His(N-Trt)-OH (Step 1).

The selective deprotection of the Lys(Aloc) group was performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin was then washed with CHCl$_3$ (6×5 mL), 20% HOAc in DCM (6×5 mL), DCM (6×5 mL), and DMF (6×5 mL). The synthesis was then re-automated for the addition of the 3-maleimidopropionic acid (Step 3). Resin cleavage and product isolation was performed using 85% TFA/5% TIS/5% thioanisole and 5% phenol, followed by precipitation by dry-ice cold Et$_2$O (Step 4). The product was purified by preparative reverse phase HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10$\mu$ phenyl-hexyl, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro-spray ionization. These steps are illustrated in the schematic diagram below.

Fmoc-Rink Amide MBHA Resin

Step 1 | SPPS

Boc-HaEGTFTSDVSSYLEGQAAKEFIAWLVKGR-Lys(Aloc)-PS

Step 2 | Pd(PPh$_3$)$_4$/NMM/HOAc/CHCl$_3$

Boc-HaEGTFTSDVSSYLEGQAAKEFIAWLVKGR-Lys-PS

Step 3 | 3-maleimidopropionic acid

-continued

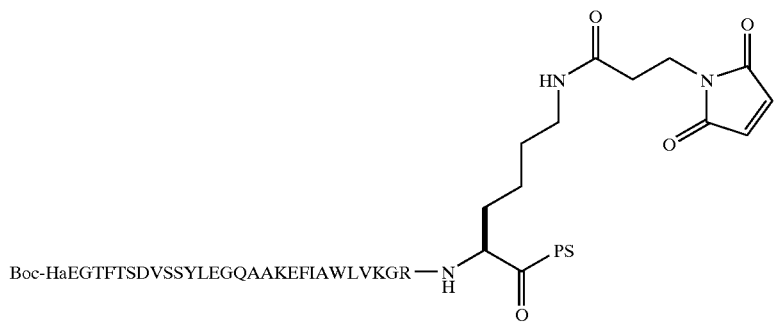

Step 4 | 85% TFA/5% TIS/5% thioanisole/5% phenol

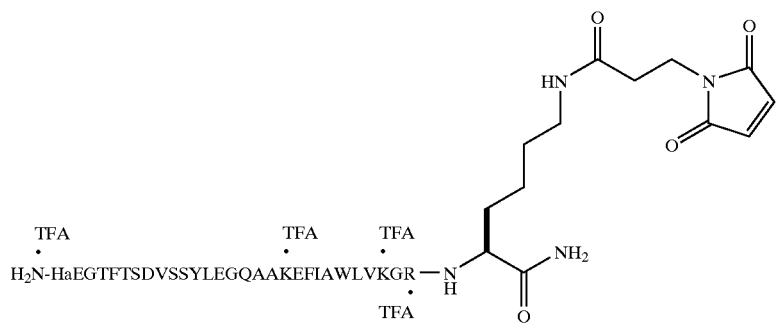

D-Ala²GLP-1(7-36)-Lys³⁷(E-MPA)-NH₂

Example 29

Modification of D-Ala² GLP-1 at the ε-Amino Group of the Added C-terminus Lysine Residue Preparation of D-Ala² GLP-1 (7-36)-Lys³⁷(Nε-AEEA-AEEA-MPA)-NH₂·4TFA His-D-Ala-Glu-Gly-Thr-Phe-Thr-Ser-Asp-Val-Ser-Ser-Tyr-Leu-Glu-Gly-Gln-Ala-Ala-Lys-Glu-Phe-Ile-Ala-Trp-Leu-Val-Lys-Gly-Arg-Lys (Nε-AEEA-AEEA-MPA)-NH₂·4TFA Using automated peptide synthesis, the following protected amino acids were sequentially added to Rink Amide MBHA resin: Fmoc-Lys(Aloc)-OH, Fmoc-Arg(Pbf)-OH, Fmoc-Gly-OH, Fmoc-Lys(tBoc)-OH, Fmoc-Val-OH, Fmoc-Leu-OH, Fmoc-Trp-OH, Fmoc-Ala-OH, Fmoc-Ile-OH, Fmoc-Phe-OH, Fmoc-Glu(OtBu)-OH, Fmoc-Lys(tBoc)-OH, Fmoc-Ala-OH, Fmoc-Ala-OH, Fmoc-Gln(Trt)-OH, Fmoc-Gly-OH, Fmoc-Glu(OtBu)-OH, Fmoc-Leu-OH, Fmoc-Tyr(Pbf)-OH, Fmoc-Ser(tBu)-OH, Fmoc-Ser(tBu)-OH, Fmoc-Val-OH, Fmoc-Asp(OtBu)-OH, Fmoc-Ser(tBu)-OH, Fmoc-Thr(tBu)-OH, Fmoc-Phe-OH, Fmoc-Thr(tBu)-OH, Fmoc-Gly-OH, Fmoc-Glu(OtBu)-OH, Fmoc-d-Ala-OH, Boc-His(N-Trt)-OH (Step 1).

The selective deprotection of the Lys(Aloc) group was performed manually and accomplished by treating the resin with a solution of 3 eq of Pd(PPh₃)₄ dissolved in 5 mL of CHCl₃:NMM:HOAc (18:1:0.5) for 2 h (Step 2). The resin was then washed with CHCl₃ (6×5 mL), 20% HOAc in DCM (6×5 mL), DCM (6×5 mL), and DMF (6×5 mL). The synthesis was then re-automated for the addition of the two AEEA (aminoethoxyethoxyacetic acid) groups and the 3-maleimidopropionic acid (Step 3). Resin cleavage and product isolation was performed using 85% TFA/5% TIS/5% thioanisole and 5% phenol, followed by precipitation by dry-ice cold Et₂O (Step 4). The product was purified by preparative reverse phase HPLC using a Varian (Rainin) preparative binary HPLC system: gradient elution of 30–55% B (0.045% TFA in H₂O (A) and 0.045% TFA in CH₃CN (B)) over 180 min at 9.5 mL/min using a Phenomenex Luna 10µ phenyl-hexyl, 21 mm×25 cm column and UV detector (Varian Dynamax UVD II) λ 214 and 254 nm. The product had >95% purity as determined by RP-HPLC mass spectrometry using a Hewlett Packard LCMS-1100 series spectrometer equipped with a diode array detector and using electro-spray ionization. These steps are illustrated in the schematic diagram below.

Fmoc-Rink Amide MBHA Resin

[Step 1] | SPPS

Boc-HaEGTFTSDVSSYLEGQAAKEFIAWLVKGR-Lys(Aloc)-PS

[Step 2] | Pd(PPh$_3$)$_4$/NMM/HOAc/CHCl$_3$

Boc-HaEGTFTSDVSSYLEGQAAKEFIAWLVKGR-Lys-PS

[Step 3] | 1. Fmoc-AEEA-OH (2 times)
          2. 3-maleimidopropionic acid

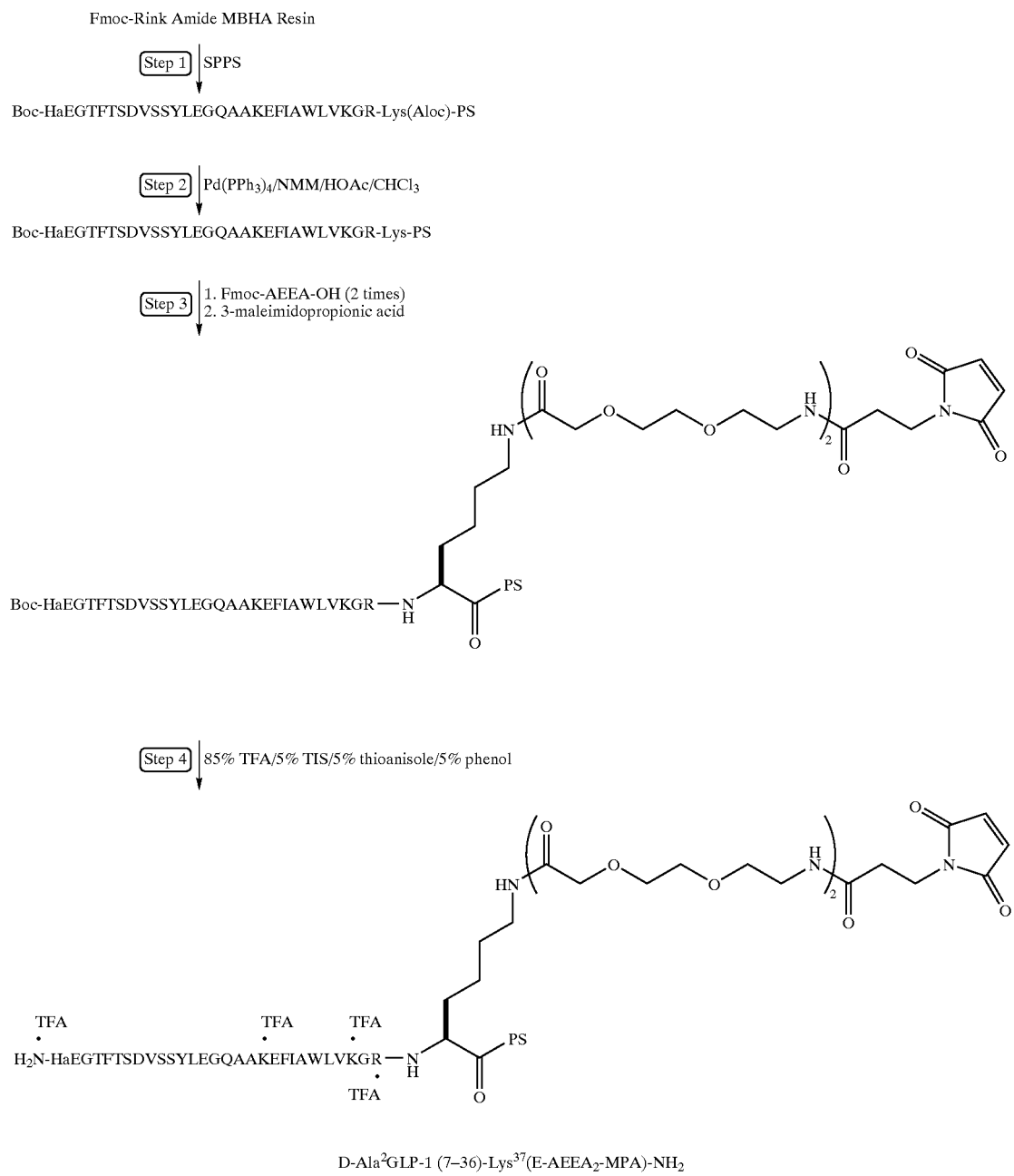

[Step 4] | 85% TFA/5% TIS/5% thioanisole/5% phenol

D-Ala$^2$GLP-1 (7–36)-Lys$^{37}$(E-AEEA$_2$-MPA)-NH$_2$

Example 30

Modification of Exendin-4(1-39) at the ε-Amino Group of the Added C-terminus Lysine Residue
Preparation of Exendin-4 (1-39)-Lys$^{40}$(Nε-MPA)-NH$_2$; His-Gly-Glu-Gly-Thr-Phe-Thr-Ser-Asp-Leu-Ser-Lys-Gln-Met-Glu-Glu-Glu-Ala-Val-Arg-Leu-Phe-Ile-Glu-Trp-Leu-Lys-Asn-Gly-Gly-Pro-Ser-Ser-Gly-Ala-Pro-Pro-Pro-Ser-Lys (Nε-MPA)-NH$_2$.5TFA Using automated peptide synthesis, the following protected amino acids were sequentially added to Rink Amide MBHA resin: Fmoc-Lys(Aloc)-OH, Fmoc-Ser(tBu)-OH, Fmoc-Pro-OH, Fmoc-Pro-OH, Fmoc-Pro-OH, Fmoc-Ala-OH, Fmoc-Gly-OH, Fmoc-Ser-OH, Fmoc-Ser(tBu)-OH, Fmoc-Pro-OH, Fmoc-Gly-OH, Fmoc-Gly-OH, Fmoc-Asn (Trt)-OH, Fmoc-Lys(Boc)-OH, Fmoc-Leu-OH, Fmoc-Trp-OH, Fmoc-Glu(OtBu)-OH, Fmoc-Ile-OH, Fmoc-Phe-OH, Fmoc-Leu-OH, Fmoc-Arg(Bpf)-OH, Fmoc-Val-OH, Fmoc-Ala-OH, Fmoc-Glu(OtBu)-OH, Fmoc-Glu(OtBu)-OH, Fmoc-Glu(OtBu)-OH, Fmoc-Met-OH, Fmoc-Gln(Trt)-OH, Fmoc-Lys(Boc)-OH, Fmoc-Ser(tBu)-OH, Fmoc-Leu-OH, Fmoc-Asp(OtBu)-OH, Fmoc-Ser(tBu)-OH, Fmoc-Thr (tBu)-OH, Fmoc-Phe-OH, Fmoc-Thr(tBu)-OH, Fmoc-Gly-OH, Fmoc-Glu(OtBu)-OH, Fmoc-Gly-OH, Boc-His(Trt)-OH (Step 1).

The selective deprotection of the Lys(Aloc) group was performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin was then washed with CHCl$_3$ (6×5 mL), 20% HOAc in DCM (6×5 mL), DCM (6×5 mL), and DMF (6×5 mL). The synthesis was then re-automated for the addition of the 3-maleimidopropionic acid (Step 3). Resin cleavage and product isolation was performed using 85% TFA/5% TIS/ 5% thioanisole and 5% phenol, followed by precipitation by dry-ice cold Et$_2$O (Step 4). The product was purified by preparative reverse phase HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro-spray ionization. These steps are illustrated in the schematic diagram below.

Leu-Ser-Lys-Gln-Met-Glu-Glu-Glu-Ala-Val-Arg-Leu-Phe-Ile-Glu-Trp-Leu-Lys-Asn-Gly-Gly-Pro-Ser-Ser-Gly-Ala-Pro-Pro-Pro-Ser-Lys(Nε-AEEA-AEEA-MPA)-NH$_2$.5TFA

Using automated peptide synthesis, the following protected amino acids were sequentially added to Rink Amide MBHA resin: Fmoc-Lys(Aloc)-OH, Fmoc-Ser(tBu)-OH, Fmoc-Pro-OH, Fmoc-Pro-OH, Fmoc-Pro-OH, Fmoc-Ala-OH, Fmoc-Gly-OH, Fmoc-Ser-OH, Fmoc-Ser(tBu)-OH, Fmoc-Pro-OH, Fmoc-Gly-OH, Fmoc-Gly-OH, Fmoc-Asn(Trt)-OH, Fmoc-Lys(Boc)-OH, Fmoc-Leu-OH, Fmoc-Trp-OH, Fmoc-Glu(OtBu)-OH, Fmoc-Ile-OH, Fmoc-Phe-OH, Fmoc-Leu-OH, Fmoc-Arg(Bpf)-OH, Fmoc-Val-OH, Fmoc-Ala-OH, Fmoc-Glu(OtBu)-OH, Fmoc-Glu(OtBu)-OH, Fmoc-Glu(OtBu)-OH, Fmoc-Met-OH, Fmoc-Gln(Trt)-OH,

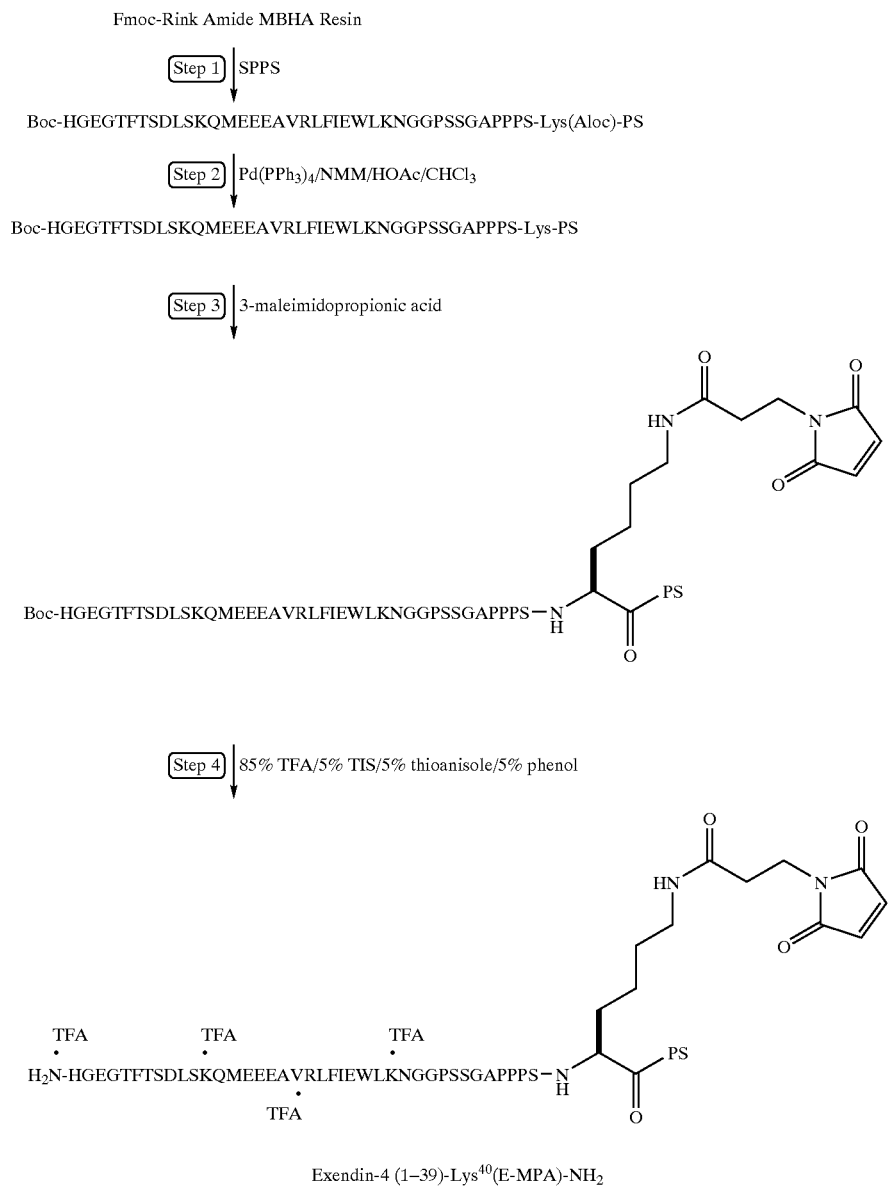

Exendin-4 (1–39)-Lys$^{40}$(E-MPA)-NH$_2$

Example 31
Modification of Exendin-4(1-39) at the ε-Amino Group of the Added C-terminus Lysine Residue
Preparation of Exendin-4 (1-39)-Lys$^{40}$(Nε-AEEA-AEEA-MPA)-NH$_2$.5TFA; His-Gly-Glu-Gly-Thr-Phe-Thr-Ser-Asp- Fmoc-Lys(Boc)-OH, Fmoc-Ser(tBu)-OH, Fmoc-Leu-OH, Fmoc-Asp(OtBu)-OH, Fmoc-Ser(tBu)-OH, Fmoc-Thr(tBu)-OH, Fmoc-Phe-OH, Fmoc-Thr(tBu)-OH, Fmoc-Gly-OH, Fmoc-Glu(OtBu)-OH, Fmoc-Gly-OH, Boc-His(Trt)-OH (Step 1).

The selective deprotection of the Lys(Aloc) group was performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin was then washed with CHCl$_3$ (6×5 mL), 20% HOAc in DCM (6×5 mL), DCM (6×5 mL), and DMF (6×5 mL). The synthesis was then re-automated for the addition of the two AEEA (aminoethoxyethoxyacetic acid) groups and the 3-maleimidopropionic acid (Step 3). Resin cleavage and product isolation was performed using 85% TFA/5% TIS/ 5% thioanisole and 5% phenol, followed by precipitation by dry-ice cold Et$_2$O (Step 4). The product was purified by preparative reverse phase HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro-spray ionization. These steps are illustrated in the schematic diagram below.

Exendin-4 (1–39)-Lys$^{40}$(E-AEEA$_2$-MPA)-NH$_2$

Example 32
Modification of Exendin-3(1-39) at the ε-Amino Group of the Added C-terminus Lysine Residue
Preparation of Exendin-3 (1-39)-Lys$^{40}$(Nε-MPA)NH$_2$.5TFA; His-Ser-Asp-Gly-Thr-Phe-Thr-Ser-Asp-Leu-Ser-Lys-Gln-Met-Glu-Glu-Glu-Ala-Val-Arg-Leu-Phe-Ile-Glu-Trp-Leu-Lys-Asn-Gly-Gly-Pro-Ser-Ser-Gly-Ala-Pro-Pro-Pro-Ser-Lys(Nε-MPA)NH$_2$.5TFA Using automated peptide synthesis, the following protected amino acids were sequentially added to Rink Amide MBHA resin: Fmoc-Lys(Aloc)-OH, Fmoc-Ser(tBu)-OH, Fmoc-Pro-OH, Fmoc-Pro-OH, Fmoc-Pro-OH, Fmoc-Ala-OH, Fmoc-Gly-OH, Fmoc-Ser-OH, Fmoc-Ser(tBu)-OH, Fmoc-Pro-OH, Fmoc-Gly-OH, Fmoc-Gly-OH, Fmoc-Asn(Trt)-OH, Fmoc-Lys(Boc)-OH, Fmoc-Leu-OH, Fmoc-Trp-OH, Fmoc-Glu(OtBu)-OH, Fmoc-Ile-OH, Fmoc-Phe-OH, Fmoc-Leu-OH, Fmoc-Arg(Bpf)-OH, Fmoc-Val-OH, Fmoc-Ala-OH, Fmoc-Glu(OtBu)-OH, Fmoc-Glu(OtBu)-OH, Fmoc-Glu(OtBu)-OH, Fmoc-Met-OH, Fmoc-Gln(Trt)-OH, Fmoc-Lys(Boc)-OH, Fmoc-Ser(tBu)-OH, Fmoc-Leu-OH, Fmoc-Asp(OtBu)-OH, Fmoc-Ser(tBu)-OH, Fmoc-Thr(tBu)-OH, Fmoc-Phe-OH, Fmoc-Thr(tBu)-OH, Fmoc-Gly-OH, Fmoc-Asp(OtBu)-OH, Fmoc-Ser(OtBu)-OH, Boc-His(Trt)-OH (Step 1).

The selective deprotection of the Lys(Aloc) group was performed manually and accomplished by treating the resin with a solution of 3 eq of Pd(PPh$_3$)$_4$ dissolved in 5 mL of CHCl$_3$:NMM:HOAC (18:1:0.5) for 2 h (Step 2). The resin was then washed with CHCl$_3$ (6×5 mL), 20% HOAc in DCM (6×5 mL), DCM (6×5 mL), and DMF (6×5 mL). The synthesis was then re-automated for the addition of the 3-maleimidopropionic acid (Step 3). Resin cleavage and product isolation was performed using 85% TFA/5% TIS/5% thioanisole and 5% phenol, followed by precipitation by dry-ice cold Et$_2$O (Step 4). The product was purified by preparative reverse phase HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro-spray ionization. These steps are illustrated in the schematic diagram below.

Fmoc-Rink Amide MBHA Resin

[Step 1] | SPPS

H$_2$N-HSDGTFTSDLSKQMEEEAVRLFIEWLKNGGPSSGAPPPS-PS

[Step 2] | 85% TFA/5% TIS/5% thioanisole/5% phenol

TFA     TFA     TFA
•     •     •
H$_2$N-HSDGTFTSDLSKQMEEEAVRLFIEWLKNGGPSSGAPPPS-NH$_2$
•
TFA

Exendin-3 (1–39)-NH$_2$

Example 33
Modification of Exendin-3(1-39) at the ε-Amino Group of the Added C-terminus Lysine Residue
Preparation of Exendin-3 (1-39)-Lys$^{40}$(Nε-AEEA-AEEA-MPA)-NH$_2$.5TFA; His-Ser-Asp-Gly-Thr-Phe-Thr-Ser-Asp-Leu-Ser-Lys-Gln-Met-Glu-Glu-Glu-Ala-Val-Arg-Leu-Phe-Ile-Glu-Trp-Leu-Lys-Asn-Gly-Gly-Pro-Ser-Ser-Gly-Ala-Pro-Pro-Pro-Ser-Lys(Nε-AEEA-AEEA-MPA)-NH$_2$.5TFA Using automated peptide synthesis, the following protected amino acids were sequentially added to Rink Amide MBHA resin: Fmoc-Lys(Aloc)-OH, Fmoc-Ser(tBu)-OH, Fmoc-Pro-OH, Fmoc-Pro-OH, Fmoc-Pro-OH, Fmoc-Ala-OH, Fmoc-Gly-OH, Fmoc-Ser-OH, Fmoc-Ser(tBu)-OH, Fmoc-Pro-OH, Fmoc-Gly-OH, Fmoc-Gly-OH, Fmoc-Asn(Trt)-OH, Fmoc-Lys(Boc)-OH, Fmoc-Leu-OH, Fmoc-Trp-OH, Fmoc-Glu(OtBu)-OH, Fmoc-Ile-OH, Fmoc-Phe-OH, Fmoc-Leu-OH, Fmoc-Arg(Bpf)-OH, Fmoc-Val-OH, Fmoc-Ala-OH, Fmoc-Glu(OtBu)-OH, Fmoc-Glu(OtBu)-OH, Fmoc-Glu(OtBu)-OH, Fmoc-Met-OH, Fmoc-Gln(Trt)-OH, Fmoc-Lys(Boc)-OH, Fmoc-Ser(tBu)-OH, Fmoc-Leu-OH, Fmoc-Asp(OtBu)-OH, Fmoc-Ser(tBu)-OH, Fmoc-Thr(tBu)-OH, Fmoc-Phe-OH, Fmoc-Thr(tBu)-OH, Fmoc-Gly-OH, Fmoc-Asp(OtBu)-OH, Fmoc-Ser(OtBu)-OH, Boc-His(Trt)-OH (Step 1).

The selective deprotection of the Lys(Aloc) group was performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin was then washed with CHCl$_3$ (6×5 mL), 20% HOAc in DCM (6×5 mL), DCM (6×5 mL), and DMF (6×5 mL. The synthesis was then re-automated for the addition of the two AEEA (aminoethoxyethoxyacetic acid) groups and the 3-maleimidopropionic acid (Step 3). Resin cleavage and product isolation was performed using 85% TFA/5% TIS/5% thioanisole and 5% phenol, followed by precipitation by dry-ice cold Et$_2$O (Step 4). The product was purified by preparative reverse phase HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro-spray ionization.

Example 34
Modification of HIV-1 DP 178 at the C-Terminus
Preparation of Modified HIV-1 DP 178 antifusogenic Peptide Tyr-Thr-Ser-Leu-Ile-His-Ser-Leu-Ile-Glu-Glu-Ser-Gln-Asn-Glu-Glu-Glu-Lys-Asn-Glu-Glu-Glu-Leu-Leu-Glu-Leu-Asp-Lys-Trp-Ala-Ser-Leu-Trp-Asn-Trp-Phe-Lys-(Nε-MPA)-NH$_2$ Using automated peptide synthesis, the following protected amino acids are sequentially added to Rink Amide MBHA resin: Fmoc-Lys(Mtt)-OH, Fmoc-Phe-OH, Fmoc-Trp(Boc)-OH, Fmoc-Asn(Trt)-OH, Fmoc-Trp(Boc)-OH, Fmoc-Leu-OH, Fmoc-Ser(tBu)-OH, Fmoc-Ala-OH, Fmoc-Trp(Boc)-OH, Fmoc-Lys(Boc)-OH, Fmoc-Asp(tBu)-OH, Fmoc-Leu-OH, Fmoc-Glu(tBu)-OH, Fmoc-Leu-OH, Fmoc-Leu-OH, Fmoc-Glu(Thu)-OH, Fmoc-Gln(Trt)-OH, Fmoc-Glu(tBu)-OH, Fmoc-Asn(Trt)-OH, Fmoc-Lys(Boc)-OH, Fmoc-Glu(tBu)-OH, Fmoc-Gln(Trt)-OH, Fmoc-Gln(Trt)-OH, Fmoc-Asn(Trt)-OH; Fmoc-Gln(Trt)-OH, Fmoc-Ser(tBu)-OH, Fmoc-Glu(tBu)-OH, Fmoc-Glu(tBu)-OH, Fmoc-Ile-OH, Fmoc-Leu-OH, Fmoc-Ser(tBu)-OH, Fmoc-His(Trt)-OH, Fmoc-Ile-OH, Fmoc-Leu-OH, Fmoc-Ser(tBu)-OH, Fmoc-Thr(tBu)-OH and Boc-Tyr(tBu)-OH. Manual synthesis is employed for the remaining steps: selective removal of the Mtt group and coupling of maleimidopropionic acid (MPA) using HBTU/HOBt/DIEA activation in DMF. The target molecule is removed from the resin; the product is isolated by precipitation and purified by prepara-

Example 35
Modification of HIV-1 DP 107 at the C-Terminus
Preparation of Modified HIV-1 DP 107 Antifusogenic Peptide Asn-Asn-Leu-Leu-Arg-Ala-Ile-Glu-Ala-Glu-Glu-His-Leu-Leu-Glu-Leu-Thr-Val-Trp-Glu-Ile-Lys-Glu-Leu-Glu-Ala-Arg-Ile-Leu-Ala-Val-Glu-Arg-Tyr-Leu-Lys-Asp-Glu-Lys-(Nε-MPA)NH$_2$ Using automated peptide synthesis, the following protected amino acids are sequentially added to Rink Amide MBHA resin: Fmoc-Lys(Mtt)-OH, Fmoc-Gln(Trt)-OH, Fmoc-Asp(tBu)-OH, Fmoc-Lys(Boc)-OH, Fmoc-Leu-OH, Fmoc-Tyr(tBu)-OH, Fmoc-Arg(Pbf)-OH, Fmoc-Glu(tBu)-OH, Fmoc-Val-OH, Fmoc-Ala-OH, Fmoc-Leu-OH, Fmoc-Ile-OH, Fmoc-Arg(Pbf)-OH, Fmoc-Ala-OH, Fmoc-Gln(Trt)-OH, Fmoc-Leu-OH, Fmoc-Gln(Trt)-OH, Fmoc-Lys(Boc)-OH, Fmoc-Ile-OH, Fmoc-Gln(Trt)-OH, Fmoc-Trp(Boc)-OH, Fmoc-Val-OH, Fmoc-Thr(tBu)-OH, Fmoc-Leu-OH, Fmoc-Gln(Trt)-OH, Fmoc-Leu-OH, Fmoc-Leu-OH, Fmoc-His(Trt)-OH, Fmoc-Gln(Trt)-OH, Fmoc-Gln(Trt)-OH, Fmoc-Ala-OH, Fmoc-Glu(tBu)-OH, Fmoc-Ile-OH, Fmoc-Ala-OH, Fmoc-Arg(Pbf)-OH, Fmoc-Leu-OH, Fmoc-Leu-OH, Fmoc-Asn(Trt)-OH, Fmoc-Asn(Trt)-OH. Manual synthesis is employed for the remaining steps: selective removal of the Mtt group and coupling of maleimidopropionic acid (MPA) using HBTU/HOBt/DIEA activation in DMF. The target analog is removed from the resin; the product is isolated by precipitation and purified by preparative HPLC to afford the desired product as a white solid upon lyophilization.

2. Modification of the Therapeutic Peptide at the N-Terminus

Example 36
Modification of RSV Peptide at the ε-Amino Group of the Added N-terminus Lysine Residue
Preparation of (Nε-MPA)-Lys-Val-Ile-Thr-Ile-Glu-Leu-Ser-Asn-Ile-Lys-Glu-Asn-Lys-Met-Asn-Gly-Ala-Lys-Val-Lys-Leu-Ile-Lys-Gln-Glu-Leu-Asp-Lys-Tyr-Lys-Asn-Ala-Val Solid phase peptide synthesis of a modified RSV peptide on a 100 μmole scale is performed using manual solid-phase synthesis, a Symphony Peptide Synthesizer and Fmoc protected Rink Amide MBHA. The following protected amino adds are sequentially added to resin: Fmoc-Val-OH, Fmoc-Ala-OH, Fmoc-Asn(Trt)-OH, Fmoc-Lys(Boc)-OH, Fmoc-Tyr(tBu)-OH, Fmoc-Lys(Boc)-OH, Fmoc-Asp(tBu)-OH, Fmoc-Leu-OH, Fmoc-Glu(tBu)-OH, Fmoc-Gln(Trt)-OH, Fmoc-Lys(Boc)-OH, Fmoc-Ile-OH, Fmoc-Leu-OH, Fmoc-Lys(Boc)-OH, Fmoc-Val-OH, Fmoc-Lys(Boc)-OH, Fmoc-Ala-OH, Fmoc-Gly-OH, Fmoc-Asn(Trt)-OH, Fmoc-Met-OH, Fmoc-Lys(Boc)-OH, Fmoc-Asn(Trt)-OH, Fmoc-Glu(tBu)-OH, Fmoc-Lys(Boc)-OH, Fmoc-Ile-OH, Fmoc-Asn(Trt)-OH, Fmoc-Ser(tBu)-OH, Fmoc-Leu-OH, Fmoc-Glu(tBu)-OH, Fmoc-Ile-OH, Fmoc-Thr(tBu)-OH, Fmoc-Ile-OH, Fmoc-Val-OH, Fmoc-Lys(Aloc)-OH. They are dissolved in N,N-dimethylformamide (DMF) and, according to the sequence, activated using O-benzotriazol-1-yl-N,N,N',N'-tetramethyl-uronium hexafluorophosphate (HBTU) and Diisopropylethylamine (DIEA). Removal of the Fmoc protecting group is achieved using a solution of 20% (V/V) piperidine in N,N-dimethylformamide (DMF) for 20 minutes (Step 1). The selective deprotection of the Lys (Aloc) group is performed manually and accomplished by treating the resin with a solution of 3 eq of Pd(PPh3)4 dissolved in 5 mL of CHCl3:NMM:HOAc (18:1:0.5) for 2 h (Step 2). The resin is then washed with CHCl3 (6×5 mL), 20% HOAc in DCM (6×5 mL), DCM (6×5 mL), and DMF (6×5 mL). The synthesis is then re-automated for the addition of the 3-maleimidopropionic acid (Step 3). Between every coupling, the resin is washed 3 times with N,N-dimethylformamide (DMF) and 3 times with isopropanol. The peptide is cleaved from the resin using 85% TFA/5% TIS/5% thioanisole and 5% phenol, followed by precipitation by dry-ice cold Et2O (Step 4). The product is purified by preparative reversed phased HPLC using a Varian (Rainin) preparative binary HPLC system: gradient elution of 30–55% B (0.045% TFA in H2O (A) and 0.045% TFA in CH3CN (B)) over 180 min at 9.5 mL/min using a Phenomenex Luna 10μ phenyl-hexyl, 21 mm×25 cm column and UV detector (Varian Dynamax UVD II) at λ 214 and 254 nm to afford the desired DAC in >95% purity, as determined by RP-HPLC.

Example 37
Modification of Neuropeptide Y at the ε-Amino Group of the Added N-terminus Lysine Residue
Preparation of (Nε-MPA)-Lys-Tyr-Pro-Ser-Lys-Pro-Glu-Asn-Pro-Gly-Glu-Asp-Ala-Pro-Ala-Glu-Asp-Met-Ala-Arg-Tyr-Tyr-Ser-Ala-Leu Solid phase peptide synthesis of a modified neuropeptide Y on a 100 μmole scale was performed using manual solid-phase synthesis, a Symphony Peptide Synthesizer and Fmoc protected Rink Amide MBHA. The following protected amino acids are sequentially added to resin: Fmoc-Leu-OH, Fmoc-Ala-OH, Fmoc-Ser(tBu)-OH, Fmoc-Tyr(tBu)-OH, Fmoc-Tyr(tBu)-OH, Fmoc-Arg(Pbf)-OH, Fmoc-Ala-OH, Fmoc-Met-OH, Fmoc-Asp(tBu)-OH, Fmoc-Glu(tBu)-OH, Fmoc-Ala-OH, Fmoc-Pro-OH, Fmoc-Ala-OH, Fmoc-Asp(tBu)-OH, Fmoc-Glu(tBu)-OH, Fmoc-Gly-OH, Fmoc-Pro-OH, Fmoc-Asn(Trt)-OH, Fmoc-Glu(tBu)-OH, Fmoc-Pro-OH, Fmoc-Lys(Boc)-OH, Fmoc-Ser(tBu)-OH, Fmoc-Pro-OH, Fmoc-Tyr(tBu)-OH, Fmoc-Lys(Aloc)-OH. They are dissolved in N,N-dimethylformamide (DMF) and, according to the sequence, activated using O-benzotriazol-1-yl-N,N,N',N'-tetramethyl-uronium hexafluorophosphate (HBTU) and Diisopropylethylamine (DIEA). Removal of the Fmoc protecting group is achieved using a solution of 20% (V/V) piperidine in N,N-dimethylformamide (DMF) for 20 minutes (Step 1). The selective deprotection of the Lys (Aloc) group is performed manually and accomplished by treating the resin with a solution of 3 eq of Pd(PPh3)4 dissolved in 5 mL of CHCl3:NMM:HOAc (18:1:0.5) for 2 h (Step 2). The resin is then washed with CHCl3 (6×5 mL), 20% HOAc in DCM (6×5 mL), DCM (6×5 mL), and DMF (6×5 mL). The synthesis is then re-automated for the addition of the 3-maleimidopropionic acid (Step 3). Between every coupling, the resin is washed 3 times with N,N-dimethylformamide (DMF) and 3 times with isopropanol. The peptide is cleaved from the resin using 85% TFA/5% TIS/5% thioanisole and 5% phenol, followed by precipitation by dry-ice cold Et2O (Step 4). The product is purified by preparative reverse phase HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm to afford the desired DAC in >95% purity, as determined by RP-HPLC.

Example 38
Modification of Neuropeptide Y at the ε-Amino Group of the Added N-terminus Lysine Residue Preparation of (N-εMPA)-Lys-Tyr-Pro-Ser-Lys-Pro-Asp-Asn-Pro-Gly-Glu-Asp-Ala-Pro-Ala-Glu-Asp-Met-Ala-Arg-Tyr-Tyr-Ser-Ala-Leu Solid phase peptide synthesis of a modified neuropeptide Y on a 100 μmole scale was performed using manual solid-phase synthesis, a Symphony Peptide Synthesizer and Fmoc protected Rink Amide MBHA. The following protected amino acids are sequentially added to resin: Fmoc-Leu-OH, Fmoc-Ala-OH, Fmoc-Ser(tBu)-OH, Fmoc-Tyr(tBu)-OH, Fmoc-Tyr(tBu)-OH, Fmoc-Arg(Pbf)-OH, Fmoc-Ala-OH, Fmoc-Met-OH, Fmoc-Asp(tBu)-OH, Fmoc-Glu(tBu)-OH, Fmoc-Ala-OH, Fmoc-Pro-OH, Fmoc-Ala-OH, Fmoc-Asp(tBu)-OH, Fmoc-Glu(tBu)-OH, Fmoc-Gly-OH, Fmoc-Pro-OH, Fmoc-Asn(Trt)-OH, Fmoc-Asp(tBu)-OH, Fmoc-Pro-OH, Fmoc-Lys(Boc)-OH, Fmoc-Ser(tBu)-OH, Fmoc-Pro-OH, Fmoc-Tyr(tBu)-OH, Fmoc-Lys(Aloc)-OH. They are dissolved in N,N-dimethylformamide (DMF) and, according to the sequence, activated using O-benzotriazol-1-yl-N,N,N',N'-tetramethyl-uronium hexafluorophosphate (HBTU) and Diisopropylethylamine (DIEA). Removal of the Fmoc protecting group is achieved using a solution of 20% (V/V) piperidine in N,N-dimethylformamide (DMF) for 20 minutes (Step 1). The selective deprotection of the Lys (Aloc) group is performed manually and accomplished by treating the resin with a solution of 3 eq of Pd(PPh$_3$)4 dissolved in 5 mL of CHCl$_3$:NMM:HOAc (18:1:0.5) for 2 h (Step 2). The resin is then washed with CHCl$_3$ (6×5 mL), 20% HOAc in DCM (6×5 mL), DCM (6×5 mL), and DMF (6×5 mL). The synthesis is then re-automated for the addition of the 3-maleimidopropionic acid (Step 3). Between every coupling, the resin is washed 3 times with N,N-dimethylformamide (DMF) and 3 times with isopropanol. The peptide is cleaved from the resin using 85% TFA/5% TIS/5% thioanisole and 5% phenol, followed by precipitation by dry-ice cold Et2O (Step 4). The product is purified by preparative reverse phase HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm to afford the desired DAC in >95% purity, as determined by RP-HPLC.

Example 39
Modification of Dyn A 1-13 at the ε-Amino Group of the Added N-terminus Lysine Residue—Synthesis of (Nε-MPA)-Dyn A 1-13-NH$_2$ (Nε-MPA)-Lys-Tyr-Gly-Gly-Phe-Leu-Arg-Arg-Ile-Arg-Pro-Lys-Leu Solid phase peptide synthesis of a modified Dyn A 1-13 analog on a 100 μmole scale is performed using manual solid-phase synthesis, a Symphony Peptide Synthesizer and Fmoc protected Rink Amide MBHA. The following protected amino acids are sequentially added to resin: Fmoc-Lys(Boc)-OH, Fmoc-Leu-OH, Fmoc-Lys(Boc)-OH, Fmoc-Pro-OH, Fmoc-Arg(Pbf)-OH, Fmoc-Ile-OH, Fmoc-Arg(Pbf)-OH, Fmoc-Arg(Pbf)-OH, Fmoc-Leu-OH, Fmoc-Phe-OH, Fmoc-Gly-OH, Fmoc-Gly-OH, Fmoc-Tyr(tBu)-OH, Fmoc-Lys(Aloc)-OH. They were dissolved in N,N-dimethylformamide (DMF) and, according to the sequence, activated using O-benzotriazol-1-yl-N,N,N',N'-tetramethyl-uronium hexafluorophosphate (HBTU) and Diisopropylethylamine (DIEA). Removal of the Fmoc protecting group is achieved using a solution of 20% (V/V) piperidine in N,N-dimethylformamide (DMF) for 20 minutes (Step 1). The selective deprotection of the Lys (Aloc) group is performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin is then washed with CHCl$_3$ (6×5 mL) 20% HOAc in DCM (6×5 mL), DCM (6×5 mL), and DMF (6×5 mL). The synthesis is then re-automated for the addition of the 3-maleimidopropionic acid (Step 3). Between every coupling, the resin is washed 3 times with N,N-dimethylformamide (DMF) and 3 times with isopropanol. The peptide is cleaved from the resin using 85% TFA/5% TIS/5% thioanisole and 5% phenol, followed by precipitation by dry-ice cold Et$_2$O (Step 4). The product is purified by preparative reverse phase HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm to afford the desired DAC in >95% purity, as determined by RP-HPLC.

Example 40
Modification of Dyn A 2-17-NH$_2$ at the N-terminus Glycine—Synthesis of MPA-AEA$_3$-Dyn A 2-17-NH$_2$ (MPA-AEA-AEA-AEA)-Gly-Gly-Phe-Leu-Arg-Arg-Ile-Arg-Pro-Lys-Leu-Lys-Trp-Asp-Asn-Glu Using automated peptide synthesis, the following protected amino acids and maleimide were sequentially added to Rink Amide MBHA resin: Fmoc-Gln(Trt)-OH, Fmoc-Asn(Trt)-OH, Fmoc-Asp(OtBu)-OH, Fmoc-Trp(Boc)-OH, Fmoc-Lys(Boc)-OH, Fmoc-Leu-OH, Fmoc-Lys(Boc)-OH, Fmoc-Pro-OH, Fmoc-Arg(Pbf)-OH, Fmoc-Ile-OH, Fmoc-Arg(Pbf)-OH, Fmoc-Arg(Pbf)-OH, Fmoc-Leu-OH, Fmoc-Phe-OH, Fmoc-Gly-OH, Fmoc-Gly-OH, Fmoc-AEA-OH, Fmoc-AEA-OH, Fmoc-AEA-OH, and MPA. The target dynorphin analog was then removed from the resin; the product was isolated by precipitation and purified by preparative HPLC to afford the desired product as a pale yellow solid upon lyophilization in a 32% yield. Anal. HPLC indicated product to be >95% pure with R$_f$=33.44 min. ESI-MS m/z for C$_{109}$H$_{172}$N$_{35}$O$_{29}$ (MH$^+$), calcd 2436.8, found MH$^{3+}$ 813.6.

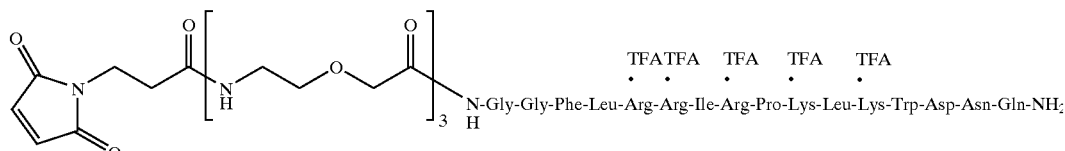

Example 42
Modification of Kringle-5 at the ε-Amino Group of the Added N-Terminus Lysine Residue
Preparation of (Nε-MPA)-Lys-Pro-Arg-Lys-Leu-Tyr-Asp-Tyr-NH$_2$.2TFA Solid phase peptide synthesis of a modified Kringle-5 analog on a 100 μmole scale was performed using manual solid-phase synthesis, a Symphony Peptide Synthesizer and Fmoc protected Rink Amide MBHA. The following protected amino acids are sequentially added to resin: Fmoc-Tyr(tBu)-OH, Fmoc-Asp(tBu)-OH, Fmoc-Tyr(tBu)-OH, Fmoc-Leu-OH, Fmoc-Lys(Boc)-OH, Fmoc-Arg(Pbf)-OH, Fmoc-Pro-OH, Fmoc-Lys(Aloc)-OH. They were dissolved in N,N-dimethylformamide (DMF) and, according to the sequence, activated using O-benzotriazol-1-yl-N,N,N'N'-tetramethyl-uronium hexafluorophosphate (HBTU) and Diisopropylethylamine (DIEA). Removal of the Fmoc protecting group is achieved using a solution of 20% (V/V) piperidine in N,N-dimethylformamide (DMF) for 20 minutes (step 1). The selective deprotection of the Lys (Aloc) group is performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin is then washed with CHCl$_3$ (6×5 mL), 20% HOAc in DCM (6×5 mL), DCM (6×5 mL), and DMF (6×5 mL). The synthesis is then re-automated for the addition of the 3male-imidopropionic acid (Step 3). Between every coupling, the resin is washed 3 times with N,N-dimethylformamide (DMF) and 3 times with isopropanol. The peptide is cleaved from the resin using 85% TFA/5% TIS/5% thioanisole and 5% phenol, followed by precipitation by dry-ice cold Et$_2$O (Step 4). The product is purified by preparative reverse phase HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm to afford the desired DAC in >95% purity, as determined by RP-HPLC.

Example 43
Modification of Kringle-5 at the N-Terminus Proline
Preparation of (MPA-AEEA)-Pro-Arg-Lys-Leu-Tyr-Asp-Tyr-Lys-NH$_2$.2TFA Using automated peptide synthesis, the following protected amino acids were sequentially added to Rink Amide MBHA resin: Fmoc-Lys(Boc)-OH, Fmoc-Tyr(tBu)OH, Fmoc-Asp(OtBu)-OH, Fmoc-Tyr(tBu)OH, Fmoc-Leu-OH, Fmoc-Lys(Boc)-OH, Fmoc-Arg(Pbf)-OH, Fmoc-Pro-OH (step 1). The deprotection of the terminal Fmoc group is accomplished using 20% piperidine (Step 2) followed by the coupling of Fmoc-AEEA. Deprotection of the resulting Fmoc-AEEA-peptide with piperidine 20% in DMF allow for the subsequent addition of the 3-MPA (Step 3). Resin cleavage and product isolation was performed using 86% TFA/5% TIS/5% H$_2$O/2% thioanisole and 2% phenol, followed by precipitation by dry-ice cold Et$_2$O (Step 4). The product was purified by preparative reversed phased HPLC using a Varian (Rainin) preparative binary HPLC system using a Dynamax C$_{18}$, 60 Å, 8 μm, 21 mm×25 cm column equipped with a Dynamax C$_{18}$, 60 Å, 8 μm guard module, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro-spray ionization.

Example 44
Modification of Kringle-5 at the N-Terminus Proline
Preparation of (MPA)-Pro-Arg-Lys-Leu-Tyr-Asp-Tyr-Lys-NH$_2$.2TFA Using automated peptide synthesis, the following protected amino acids were sequentially added to Rink Amide MBHA resin: Fmoc-Lys(Boc)-OH, Fmoc-Tyr(tBu)OH, Fmoc-Asp(OtBu)-OH, Fmoc-Tyr(tBu)OH, Fmoc-Leu-OH, Fmoc-Lys(Boc)-OH, Fmoc-Arg(Pbf)-OH, Fmoc-Pro-OH (step 1). The deprotection of the terminal Fmoc group is accomplished using 20% piperidine (Step 2) followed by the coupling of 3-MPA (Step 3). Resin cleavage and product isolation was performed using 86% TFA/5% TIS/5% H$_2$O/2% thioanisole and 2% phenol, followed by precipitation by dry-ice cold Et$_2$O (Step 4). The product was purified by preparative reversed phased HPLC using a Varian (Rainin) preparative binary HPLC system using a Dynamax C$_{18}$, 60 Å, 8 μm, 21 mm×25 cm column equipped with a Dynamax C$_{18}$, 60 Å, 8 μm guard module, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro-spray ionization

Example 45
Modification of Kringle-5 at the N-Terminus Tyrosine
Preparation of (MPA-AEEA)-Tyr-Thr-Thr-Asn-Pro-Arg-Lys-Leu-Tyr-Asp-Tyr-NH$_2$.2TFA Using automated peptide synthesis, the following protected amino acids were sequentially added to Rink Amide MBHA resin: Fmoc-Lys(Boc)-OH, Fmoc-Tyr(tBu)OH, Fmoc-Asp(OtBu)-OH, Fmoc-Tyr(tBu)OH, Fmoc-Leu-OH, Fmoc-Lys(Boc)-OH, Fmoc-Arg(Pbf)-OH, Fmoc-Pro-OH, Fmoc-Asn(Trt)-OH, Fmoc-Thr(tBu)-OH, Fmoc-Thr(tBu)-OH, Fmoc-Tyr(tBu)OH (Step 1). The deprotection of the terminal Fmoc group is accomplished using 20% piperidine (Step 2) followed by the coupling of Fmoc-AEEA. Deprotection of the resulting Fmoc-AEEA-peptide with piperidine 20% in DMF allow for the subsequent addition of the 3-MPA (Step 3). Resin cleavage and product isolation was performed using 86% TFA/5% TIS/5% H$_2$O/2% thioanisole and 2% phenol, followed by precipitation by dry-ice cold Et$_2$O (Step 4). The product was purified by preparative reversed phased HPLC using a Varian (Rainin) preparative binary HPLC system using a Dynamax C$_{18}$, 60 Å, 8 μm, 21 mm×25 cm column equipped with a Dynamax C$_{18}$, 60 Å, 8 μm guard module, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro-spray ionization.

Example 46
Modification of Kringle-5 at the N-Terminus Tyrosine
Preparation of (MPA)-Tyr-Thr-Thr-Asn-Pro-Arg-Lys-Leu-Tyr-Asp-Tyr-NH$_2$.2TFA Using automated peptide synthesis, the following protected amino acids were sequentially added to Rink Amide MBHA resin: Fmoc-Lys(Boc)-OH, Fmoc-Tyr(tBu)OH, Fmoc-Asp(OtBu)-OH, Fmoc-Tyr(tBu)OH, Fmoc-Leu-OH, Fmoc-Lys(Boc)-OH, Fmoc-Arg(Pbf)-OH, Fmoc-Pro-OH, Fmoc-Asn(Trt)-OH, Fmoc-Thr(tBu)-OH, Fmoc-Thr(tBu)-OH, Fmoc-Tyr(tBu)OH (Step 1). The deprotection of the terminal Fmoc group is accomplished using 20% piperidine (Step 2) followed by the coupling of 3-MPA (Step 3). Resin cleavage and product isolation was performed using 86%

TFA/5% TIS/5% H$_2$O/2% thioanisole and 2% phenol, followed by precipitation by dry-ice cold Et$_2$O (Step 4). The product was purified by preparative reversed phased HPLC using a Varian (Rainin) preparative binary HPLC system using a Dynamax C$_{18}$, 60 Å. 8 μm, 21 mm×25 cm column equipped with a Dynamax C$_{18}$, 60 Å, 8 μm guard module, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro-spray ionization.

Example 47
Modification of Kringle-5 at the N-Terminus Arginine
Preparation of (MPA-AEEA)-Arg-Asn-Pro-Asp-Gly-Asp-Gly-Pro-Trp-Ala-Tyr-Thr-Thr-Asn-Pro-Arg-Lys-Leu-Tyr-Asp-Tyr-NH$_2$.3TFA Using automated peptide synthesis, the following protected amino acids were sequentially added to Rink Amide MBHA resin: Fmoc-Lys(Boc)-OH, Fmoc-Tyr(tBu)OH, Fmoc-Asp(OtBu)-OH, Fmoc-Tyr(tBu)OH, Fmoc-Leu-OH, Fmoc-Lys(Boc)-OH, Fmoc-Arg(Pbf)-OH, Fmoc-Pro-OH, Fmoc-Asn(Trt)-OH, Fmoc-Thr(tBu)-OH, Fmoc-Thr(tBu)-OH, Fmoc-Tyr(tBu)OH, Fmoc-Ala-OH, Fmoc-Trp-OH, Fmoc-Pro-OH, Fmoc-Gly-OH, Fmoc-Gly-OH, Fmoc-Val-OH, Fmoc-Asp(OtBu)-OH, Fmoc-Gly-OH, Fmoc-Asp (OtBu)-OH, Fmoc-Pro-OH, Fmoc-Asn(Trt)-OH, Fmoc-Arg(Pbf)-OH (step 1). The deprotection of the terminal Fmoc group is accomplished using 20% piperidine (Step 2) followed by the coupling of Fmoc-AEEA. Deprotection of the resulting Fmoc-AEEA-peptide with piperidine 20% in DMF allow for the subsequent addition of the 3-MPA (Step 3). Resin cleavage and product isolation was performed using 86% TFA/5% TIS/5% H$_2$O/2% thioanisole and 2% phenol, followed by precipitation by dry-ice cold Et$_2$O (Step 4). The product was purified by preparative reversed phased HPLC using a Varian (Rainin) preparative binary HPLC system using a Dynamax C$_{18}$, 60 Å, 8 μm, 21 mm×25 cm column equipped with a Dynamax C$_{18}$, 60 Å, 8 μm guard module, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro-spray ionization.

Example 48
Modification of Kringle-5 at the N-Terminus Arginine
Preparation of (MPA)-Arg-Asn-Pro-Asp-Gly-Asp-Val-Gly-Gly-Pro-Trp-Ala-Tyr-Thr-Thr-Asn-Pro-Arg-Lys-Leu-Tyr-Asp-Tyr-NH$_2$.3TFA Using automated peptide synthesis, the following protected amino acids were sequentially added to Rink Amide MBHA resin: Fmoc-Lys(Boc)-OH, Fmoc-Tyr(tBu)OH, Fmoc-Asp(OtBu)-OH, Fmoc-Tyr(tBu)OH, Fmoc-Leu-OH, Fmoc-Lys(Boc)-OH, Fmoc-Arg(Pbf)-OH, Fmoc-Pro-OH, Fmoc-Asn(Trt)-OH, Fmoc-Thr(tBu)-OH, Fmoc-Thr(tBu)-OH, Fmoc-Tyr(tBu)OH, Fmoc-Ala-OH, Fmoc-Trp-OH, Fmoc-Pro-OH, Fmoc-Gly-OH, Fmoc-Gly-OH, Fmoc-Val-OH, Fmoc-Asp(OtBu)-OH, Fmoc-Gly-OH, Fmoc-Asp (OtBu)-OH, Fmoc-Pro-OH, Fmoc-Asn(Trt)-OH, Fmoc-Arg (Pbf)-OH (Step 1). The deprotection of the terminal Fmoc group is accomplished using 20% piperidine (Step 2) followed by the coupling of 3-MPA (Step 3). Resin cleavage and product isolation was performed using 86% TFA/5% TIS/5% H$_2$O/2% thioanisole and 2% phenol, followed by precipitation by dry-ice cold Et$_2$O (Step 4). The product was purified by preparative reversed phased HPLC using a Varian (Rainin) preparative binary HPLC system using a Dynamax C$_{18}$, 60 Å, 8 μm, 21 mm×25 cm column equipped with a Dynamax C$_{18}$, 60 Å, 8 μm guard module, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro-spray ionization.

Example 49
Modification of Kringle-5 at the N-Terminus Arginine
Preparation of (MPA-AEEA)-Arg-Asn-Pro-Asp-Gly-Asp-Val-Gly-Gly-Pro-Trp-NH$_2$.TFA Using automated peptide synthesis, the following protected amino acids were sequentially added to Rink Amide MBHA resin: Fmoc-Lys(Boc)-OH, Fmoc-Trp-OH, Fmoc-Pro-OH, Fmoc-Gly-OH, Fmoc-Gly-OH, Fmoc-Val-OH, Fmoc-Asp(OtBu)-OH, Fmoc-Gly-OH, Fmoc-Asp(OtBu)-OH, Fmoc-Pro-OH, Fmoc-Asn(Trt)-OH, Fmoc-Arg(Pbf)-OH (step 1). The deprotection of the terminal Fmoc group is accomplished using 20% piperidine (Step 2) followed by the coupling of Fmoc-AEEA. Deprotection of the resulting Fmoc-AEEA-peptide with piperidine 20% in DMF allow for the subsequent addition of the 3-MPA (Step 3). Resin cleavage and product isolation was performed using 86% TFA/5% TIS/5% H$_2$O/2% thioanisole and 2% phenol, followed by precipitation by dry-ice cold Et$_2$O (Step 4). The product was purified by preparative reversed phased HPLC using a Varian (Rainin) preparative binary HPLC system using a Dynamax C$_{18}$, 60 Å, 8 μm, 21 mm×25 cm column equipped with a Dynamax C$_{18}$, 60 Å, 8 μm guard module, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro-spray ionization.

Example 50
Modification of Kringle-5 at the N-Terminus Arginine
Preparation of (MPA)-Arg-Asn-Pro-Asp-Gly-Asp-Val-Gly-Gly-Pro-Trp-NH$_2$.TFA Using automated peptide synthesis, the following protected amino acids were sequentially added to Rink Amide MBHA resin: Fmoc-Lys(Boc)-OH, Fmoc-Trp-OH, Fmoc-Pro-OH, Fmoc-Gly-OH, Fmoc-Gly-OH, Fmoc-Val-OH, Fmoc-Asp(OtBu)-OH, Fmoc-Gly-OH, Fmoc-Asp(OtBu)-OH, Fmoc-Pro-OH, Fmoc-Asn(Trt)-OH, Fmoc-Arg(Pbf)-OH (Step 1). The deprotection of the terminal Fmoc group is accomplished using 20% piperidine (Step 2) followed by the coupling of 3-MPA (Step 3). Resin cleavage and product isolation was performed using 86% TFA/5% TIS/5% H$_2$O/ 2% thioanisole and 2% phenol, followed by precipitation by dry-ice cold Et$_2$O (Step 4). The product was purified by preparative reversed phased HPLC using a Varian (Rainin) preparative binary HPLC system using a Dynamax C$_{18}$, 60 Å, 8 μm, 21 mm×25 cm column equipped with a Dynamax C$_{18}$, 60 Å, 8 μm guard module, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro-spray ionization.

Example 51
Modification of Kringle-5 at the N-Terminus Arginine
Preparation of (MPA-AEEA)-Arg-Lys-Leu-Tyr-Asp-Tyr-NH$_2$.2TFA Using automated peptide synthesis, the following protected amino acids were sequentially added to Rink Amide MBHA resin: Fmoc-Lys(Boc)-OH, Fmoc-Tyr(tBu)OH, Fmoc-Asp(OtBu)-OH, Fmoc-Tyr(tBu)OH, Fmoc-Leu-OH, Fmoc-Lys(Boc)-OH, Fmoc-Arg(Pbf)-OH (Step 1). The deprotection of the terminal Fmoc group is accomplished using 20% piperidine (Step 2) followed by the coupling of Fmoc-AEEA. Deprotection of the resulting Fmoc-AEEA-peptide with piperidine 20% in DMF allow for the subsequent addition of the 3-MPA (Step 3). Resin cleavage and product isolation was performed using 86% TFA/5% TIS/5% H$_2$O/2% thioanisole and 2% phenol, followed by precipitation by dry-ice cold Et$_2$O (Step 4). The product was purified by preparative reversed phased HPLC using a Varian (Rainin) preparative binary HPLC system using a Dynamax C$_{18}$, 60 Å, 8 μm, 21 mm×25 cm column equipped with a Dynamax C$_{18}$, 60 Å, 8 μm guard module, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electrospray ionization

Example 52
Modification of Kringle-5 at the N-Terminus Arginine
Preparation of (MPA)-Arg-Lys-Leu-Tyr-Asp-Tyr-NH$_2$.2TFA Using automated peptide synthesis, the following protected amino acids were sequentially added to Rink Amide MBHA resin: Fmoc-Lys(Boc)-OH, Fmoc-Tyr(tBu)OH, Fmoc-Asp(OtBu)-OH, Fmoc-Tyr(tBu)OH, Fmoc-Leu-OH, Fmoc-Lys(Boc)-OH, Fmoc-Arg(Pbf)-OH (Step 1). The deprotection of the terminal Fmoc group is accomplished using 20% piperidine (Step 2) followed by the coupling of 3-MPA (Step 3). Resin cleavage and product isolation was performed using 86% TFA/5% TIS/5% H$_2$O/2% thioanisole and 2% phenol, followed by precipitation by dry-ice cold Et$_2$O (Step 4). The product was purified by preparative reversed phased HPLC using a Varian (Rainin) preparative binary HPLC system using a Dynamax C$_{18}$, 60 Å, 8 μm, 21 mm×25 cm column equipped with a Dynamax C$_{18}$, 60 Å, 8 μm guard module, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro spray ionization.

Example 53
Modification of Kringle-5 at the N-Terminus Proline
Preparation of (MPA-AEEA)-Pro-Arg-Lys-Leu-Tyr-Asp-NH$_2$.2TFA Using automated peptide synthesis, the following protected amino acids were sequentially added to Rink Amide MBHA resin: Fmoc-Lys(Boc)-OH, Fmoc-Asp(OtBu)-OH, Fmoc-Tyr(tBu)OH, Fmoc-Leu-OH, Fmoc-Lys(Boc)-OH, Fmoc-Arg(Pbf)-OH, Fmoc-Pro-OH (step 1). The deprotection of the terminal Fmoc group is accomplished using 20% piperidine (Step 2) followed by the coupling of Fmoc-AEEA. Deprotection of the resulting Fmoc-AEEA-peptide with piperidine 20% in DMF allow for the subsequent addition of the 3-MPA (Step 3). Resin cleavage and product isolation was performed using 86% TFA/5% TIS/5% H$_2$O/2% thioanisole and 2% phenol, followed by precipitation by dry-ice cold Et$_2$O (Step 4). The product was purified by preparative reversed phased HPLC using a Varian (Rainin) preparative binary HPLC system using a Dynamax C$_{18}$, 60 Å, 8 μm, 21 mm×25 cm column equipped with a Dynamax C$_{18}$, 60 Å, 8 μm guard module, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro-spray ionization.

Example 54
Modification of Kringle-5 at the N-Terminus Proline
Preparation of (MPA)-Pro-Arg-Lys-Lou-Tyr-Asp-NH$_2$.2TFA Using automated peptide synthesis, the following protected amino acids were sequentially added to Rink Amide MBHA resin: Fmoc-Lys(Boc)-OH, Fmoc-Asp(OtBu)-OH, Fmoc-Tyr(tBu)OH, Fmoc-Leu-OH, Fmoc-Lys(Boc)-OH, Fmoc-Arg(Pbf)-OH, Fmoc-Pro-OH (Step 1). The deprotection of the terminal Fmoc group is accomplished using 20% piperidine (Step 2) followed by the coupling of 3MPA (Step 3). Resin cleavage and product isolation was performed using 86% TFA/5% TIS/5% H$_2$O/2% thioanisole and 2% phenol, followed by precipitation by dry-ice cold Et$_2$O (Step 4). The product was purified by preparative reversed phased HPLC using a Varian (Rainin) preparative binary HPLC system using a Dynamax C$_{18}$, 60 Å, 8 μm, 21 mm×25 cm column equipped with a Dynamax C$_{18}$, 60 Å, 8 μm guard module, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro-spray ionization.

3. Modification at an Internal Amino Acid

Example 55
Synthesis of Lys$^{26}$(ε-MPA)GLP-1(7-36)-NH$_2$

Solid phase peptide synthesis of a modified GLP-1 analog on a 100 μmole scale was performed manually and on a Symphony Peptide Synthesizer using Fmoc protected Rink amide MBHA resin. The following protected amino acids are sequentially added to the resin: Fmoc-Arg(Pbf)-OH, Fmoc-Gly-OH, Fmoc-Lys(Boc)-OH, Fmoc-Val-OH, Fmoc-Leu-OH, Fmoc-Trp(Boc)-OH, Fmoc-Ala-OH, Fmoc-Ile-OH, Fmoc-Phe-OH, Fmoc-Glu(OtBu)-OH, Fmoc-Lys(Aloc)-OH, Fmoc-Ala-OH, Fmoc-Ala-OH, Fmoc-Gln(Trt)-OH, Fmoc-Gly-OH, Fmoc-Glu(OtBu)-OH, Fmoc-Leu-OH, Fmoc-Tyr(tBu)-OH, Fmoc-Ser(tBu)-OH, Fmoc-Ser(tBu)-OH, Fmoc-Val-OH, Fmoc-Asp(tBu)-OH, Fmoc-Ser(tBu)-OH, Fmoc-Thr(tBu)-OH, Fmoc-Phe-OH, Fmoc-Thr(tBu)-OH, Fmoc-Gly-OH, Fmoc-Glu(OtBu)-OH, Fmoc-Ala-OH, Boc-His(Trt)-OH. They are dissolved in N,N-dimethylformamide (DMF) and, according to the sequence, activated using O-benzotriazol-1-yl-N,N,N',N'-tetramethyl-uronium hexafluorophosphate (HBTU) and Diisopropyl-ethylamine (DIEA). Removal of the Fmoc protecting group is achieved using a solution of 20% (V/V) piperidine in N,N-dimethylformamide (DMF) for 20 minutes (Step 1). Selective deprotection of the Lys(Aloc) group is performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin is then washed with CHCl$_3$ (6×5mL), 20% HOAc in DCM (6×5mL), DCM (6×5mL), and DMF (6×5mL). The synthesis is then re-automated for the addition of the 3-maleimidopropionic acid (Step 3). Resin cleavage and product isolation is performed using 86% TFA/5% TIS/5% H$_2$O/2% thioanisole and 2% phenol, followed by precipitation by dry-ice cold Et$_2$O (Step 4). The product is purified by preparative reversed phase HPLC using a Varian (Rainin) preparative binary HPLC system using a Dynamax C$_{18}$, 60 Å, 8 μm, 21 mm×25 cm column equipped with a Dynamax C$_{18}$, 60 Å, 8 μm guard module, 21 mm×25 cm column and UV detector (Varian Dynamax UVD II) at λ 214 and 254 nm to afford the desired DAC in >95% purity, as determined by RP-HPLC. These steps are illustrated in the schematic diagram below.

Fmoc-Rink Amide MBHA Resin

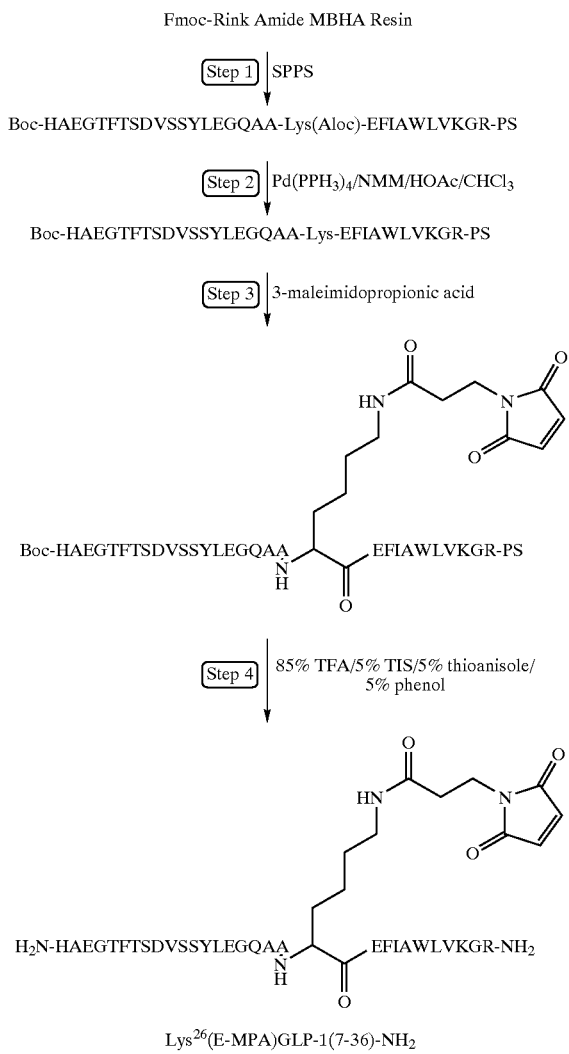

Lys$^{26}$(E-MPA)GLP-1(7-36)-NH$_2$

D. Preparation of Modified Peptides from Peptides Containing One Free Cysteine

Preparation of maleimido peptides from therapeutic peptides containing one free Cysteine is exemplified by the synthesis of peptides as described below. The peptide may be modified at the N-terminus, the C-terminus, or at an amino acid located between the N-terminus and the C-terminus.

Preparation of maleimido peptides from peptides containing multiple protected functional groups and multiple Cysteine residues all with one free Cysteine residues (i.e. all Cysteine residues, except one, are tied up as disulfides). Linking from an internal amino acid in the natural sequence as in Example 5. The free Cysteine residue must be capped or replaced with another amino acid (e.g. Alanine, Methionine, etc.).

Where the peptide contains one cysteine, the cysteine must stay capped after addition of the maleimide. If the cysteine is involved in binding site, assessment has to be made of how much potency is lost is cysteine is capped by a protecting group. If the cysteine can stay capped, then the synthetic path is similar to example (i) above. Examples of therapeutic peptides that contain one cystein include G$_\alpha$ (the alpha subunit of Gtherapeutic peptide binding protein), the 724–739 fragment of rat brain nitric oxide synthase blocking peptide, the alpha subunit 1–32 fragment of human [Tyr0] inhibin, the 254–274 fragment of HIV envelope protein, and P34cdc2 kinase fragment.

1. Modification at the N-Terminus

Example 56

Modification of Inhibin Peptide at the Added N-Terminus Lysine

Preparation of (Nε-MPA)-Lys-Tyr-Ser-Thr-Pro-Leu-Met-Ser-Trp-Pro-Trp-Ser-Pro-Ser-Ala-Leu-Arg-Leu-Leu-Gln-Arg-Pro-Pro-Glu-Glu-Pro-Ala-Ala-Ala-His-Ala-Asn-Cys-His-Arg Solid phase peptide synthesis of a modified inhibin peptide analog on a 100 μmole scale is performed using manual solid-phase synthesis, a Symphony Peptide Synthesizer and Fmoc protected Rink Amide MBHA. The following protected amino acids are sequentially added to resin: Fmoc-Arg(Pbf)-OH, Fmoc-His(Boc)-OH, Fmoc-Cys(Trt)-OH, Fmoc-Asn(Trt)-OH, Fmoc-Ala-OH, Fmoc-His(Boc)-OH, Fmoc-Ala-OH, Fmoc-Ala-OH, Fmoc-Pro-OH, Fmoc-Glu(tBu)-OH, Fmoc-Glu(tBu)-OH, Fmoc-Pro-OH, Fmoc-Pro-OH, Fmoc-Arg(Pbf)-OH, Fmoc-Gln(Trt)-OH, Fmoc-Leu-OH, Fmoc-Leu-OH, Fmoc-Arg(Pbf)-OH, Fmoc-Leu-OH, Fmoc-Ala-OH, Fmoc-Ser(tBu)-OH, Fmoc-Pro-OH, Fmoc-Ser(tBu)-OH, Fmoc-Trp(Boc)-OH, Fmoc-Pro-OH, Fmoc-Trp(Boc)-OH, Fmoc-Ser(tBu)-OH, Fmoc-Met-OH, Fmoc-Leu-OH, Fmoc-Pro-OH, Fmoc-Thr(tBu)-OH, Fmoc-Ser(tBu)-OH, Fmoc-Tyr(tBu)-OH, Fmoc-Lys(Aloc)-OH. They are dissolved in N,N-dimethylformamide (DMF) and, according to the sequence, activated using O-benzotriazol-1-yl-N,N,N',N'-tetramethyl-uronium hexafluorophosphate (HBTU) and Diisopropylethylamine (DIEA). Removal of the Fmoc protecting group is achieved using a solution of 20% (V/V) piperidine in N,N-dimethylformamide (DMF) for 20 minutes (Step 1). The selective deprotection of the Lys (Aloc) group is performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin is then washed with CHCl$_3$ (6×5 mL), 20% HOAc in DCM (6×5 mL), DCM (6×5 mL), and DMF (6×5 mL). The synthesis is then re-automated for the addition of the 3-maleimidopropionic acid (Step 3). Between every coupling, the resin is washed 3 times with N,N-dimethylformamide (DMF) and 3 times with isopropanol. The peptide is cleaved from the resin using 85% TFA/5% TIS/5% thioanisole and 5% phenol, followed by precipitation by dry-ice cold Et$_2$O (Step 4). The product is purified by preparative reverse phase HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm to afford the desired DAC in >95% purity, as determined by RP-HPLC.

Example 57

Modification of RSV Antifusogenic Peptide at the N-Terminus

Preparation of 3-(MPA)-Val-Ile-Thr-Ile-Glu-Leu-Ser-Asn-Ile-Lys-Glu-Asn-Lys-Cys-Asn-Glu-Ala-Lys-Val-Lys-Leu-Ile-Lys-Glu-Glu-Leu-Asp-Lys-Tyr-Lys-Asn-Ala-Val Initially, (Cysteine (Cys) was replaced with Methionine (Met) within the native sequence. Solid phase peptide synthesis of a modified anti RSV analog on a 100 μmole scale was performed on a Symphony Peptide Synthesizer using Fmoc protected Rink Amide MBHA resin, Fmoc protected amino acids, O-benzotriazol-1-yl-N,N,N',N'-tetramethyl-uronium hexafluorophosphate (HBTU) in N,N- dimethylformamide (DMF) solution and activation with N-methyl morpholine (NMM), and piperidine deprotection of Fmoc groups (Step 1). The deprotection of the terminal Fmoc group is accomplished using 20% piperidine (Step 2) followed by the coupling of 3-MPA (Step 3). Resin cleavage and product isolation was performed using 85% TFA/5% TIS/5% thioanisole and 5% phenol, followed by precipitation by dry-ice cold $Et_2O$ (Step 4). The product is purified by preparative reverse phase HPLC using a Varian (Rainin) preparative binary HPLC system: gradient elution of 30–55% B (0.045% TFA in $H_2O$ (A) and 0.045% TFA in $CH_3CN$ (B)) over 180 min at 9.5 mL/min using a Phenomenex Luna 10µ phenyl-hexyl, 21 mm×25 cm column and UV detector (Varian Dynamax UVD II) at λ 214 and 254 nm to afford the desired DAC in >95% purity, as determined by RP-HPLC. These steps are illustrated by the schematic diagram below.

hexafluorophosphate (HBTU) and Diisopropylethylamine (DIEA). Removal of the Fmoc protecting group is achieved using a solution of 20% (V/V) piperidine in N,N-dimethylformamide (DMF) for 20 minutes (Step 1). The selective deprotection of the Lys (Aloc) group is performed manually and accomplished by treating the resin with a solution of 3 eq of $Pd(PPh_3)_4$ dissolved in 5 mL of $CHCl_3$:NMM:HOAc (18:1:0.5) for 2 h (Step 2). The resin is then washed with $CHCl_3$ (6×5 mL), 20% HOAc in DCM (6×5 mL), DCM (6×5 mL), and DMF (6×5 mL). The synthesis is then re-automated for the addition of the 3-maleimidopropionic acid (Step 3). Between every coupling, the resin is washed 3 times with N,N-dimethylformamide (DMF) and 3 times with isopropanol. The peptide is cleaved from the resin using 85% TFA/5% TIS/5% thioanisole and 5% phenol, followed by precipitation by dry-ice cold $Et_2O$ (Step 4). The product is purified by Fmoc-Rink Amide MBHA Resin Step 1 | SPPS Fmoc-VITIELSNIKENKMNGAKVKLIKQELDKYKNAV-PS Step 2 | 20% piperidine $H_2N$-VITIELSNIKENKMNGAKVKLIKQELDKYKNAVK-PS Step 3 | 3-maleimidopropionic acid

VITIELSNIKENKMNGAKVKLIKQELDKYKNAV-PS

Step 4 | 85% TFA/5% TIS/5% thioanisole/5% phenol

VITIELSNIKENKMNGAKVKLIKQELDKYKNAV-$NH_2$
· TFA · TFA · TFA · TFA
· TFA · TFA · TFA

2. Modification at the C-Terminus

Example 58

Modification of Inhibin Peptide at the Added C-Terminus Lysine

Preparation of (Nε-MPA)-Lys-Cys-Asn-Leu-Lys-Glu-Asp-Gly-Ile-Ser-Ala-Ala-Lys-Asp-Val-Lys Solid phase peptide synthesis of a modified inhibin peptide analog on a 100 µmole scale is performed using manual solid-phase synthesis, a Symphony Peptide Synthesizer and Fmoc protected Rink Amide MBHA. The following protected amino acids are sequentially added to resin: Fmoc-Lys(Boc)-OH, Fmoc-Val-OH, Fmoc-Asp(tBu)-OH, Fmoc-Lys(Boc)-OH, Fmoc-Ala-OH, Fmoc-Ala-OH, Fmoc-Ser(tBu)-OH, Fmoc-Ile-OH, Fmoc-Gly-OH, Fmoc-Asp(tBu)-OH, Fmoc-Glu(tBu)-OH, Fmoc-Lys(Boc)-OH, Fmoc-Leu-OH, Fmoc-Asn(Trt)-OH, Fmoc-Cys(Trt)-OH, Fmoc-Lys(Aloc)-OH, They are dissolved in N,N-dimethylformamide (DMF) and, according to the sequence, activated using O-benzotriazol-1-yl-N,N,N',N'-tetramethyl-uronium preparative reverse phase HPLC using a Varian (Rainin) preparative binary HPLC system: gradient elution of 30–55% B (0.045% TFA in $H_2O$ (A) and 0.045% TFA in $CH_3CN$ (B)) over 180 min at 9.5 mL/min using a Phenomenex Luna 10µ phenyl-hexyl, 21 mm×25 cm column and UV detector (Varian Dynamax UVD II) at λ 214 and 254 nm to afford the desired DAC in >95% purity, as determined by RP-HPLC.

Example 59

Modification of RSV Fusogenic Peptide at the C-Terminus Val-Ile-Thr-Ile-Glu-Leu-Ser-Asn-Ile-Lys-Glu-Asn-Lys-Cys-Asn-Gly-Ala-Lys-Val-Lys-Leu-Ile-Lys-Gln-Glu-Leu-Asp-Lys-Tyr-Asn-Ala-Val-(AEEA.MPA)

Preparation of maleimido peptides from peptides containing multiple protected functional groups and one cysteine is exemplified by the synthesis of a modified RSV fusogenic peptide. The modified RSV fusogenic peptide was synthesized by linking off the C-terminus by the addition of a lysine residue to the natural peptide sequence as illustrated by the schematic diagram below. In cases where a cysteine residue is contained within the peptide sequence and is not essentially to the biological activity of the peptide, this residue must be replaced with another amino acid (e.g. alanine, methionine, etc.). In the following synthesis, the cysteine (Cys) was replaced with a methionine (Met) within the native RSV sequence.

Solid phase peptide synthesis of the maleimido RSV fusogenic peptide on a 100 μmole scale is performed using manual solid-phase synthesis and a Symphony Peptide Synthesizer using Fmoc protected Rink Amide MBHA resin, Fmoc protected amino acids, O-benzotriazol-1-yl-N,N,N', N'-tetramethyl-uronium hexafluorophosphate (HBTU) in N,N-dimethylformamide (DMF) solution and activation with N-methyl morpholine (NMM), and piperidine deprotection of Fmoc groups (Step 1). The selective deprotection of the Lys(Aloc) group is performed manually and accomplished by treating the resin with a solution of 3 eq of Pd(PPh$_3$)$_4$ dissolved in 5 mL of CHCl$_3$:NMM:HOAc (18:1:0.5) for 2 h (Step 2). The resin is then washed with CHCl$_3$ (6×5 mL), 20% HOAc in DCM (6×5 mL), DCM (6×5 mL), and DMF (6×5 mL). The synthesis is then re-automated for the addition of 3-maleimidopropionic acid (Step 3). Resin cleavage and product isolation is performed using 85% TFA/5% TIS/5% thioanisole and 5% phenol, followed by precipitation by dry-ice cold Et$_2$O (Step 4). The product is purified by preparative reverse phase HPLC using a Varian (Rainin) preparative binary HPLC system: gradient elution of 30–55% B (0.045% TFA in H$_2$O (A) and 0.045% TFA in CH$_3$CN (B)) over 180 min at 9.5 mL/min using a Phenomenex Luna 10μ phenyl-hexyl, 21 mm×25 cm column and UV detector (Varian Dynamax UVD II) at λ 214 and 254 nm to afford the desired DAC in >95% purity, as determined by RP-HPLC. These steps are illustrated in the schematic diagram below.

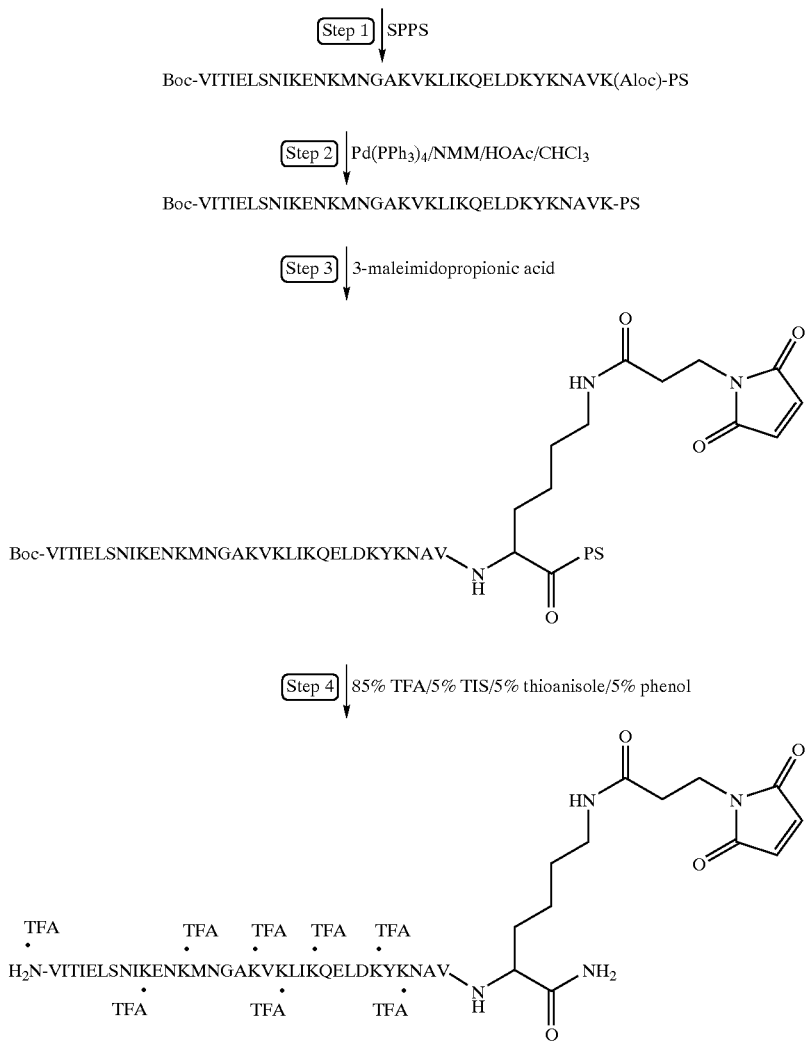

3. Modification at an Internal Amino Acid

Example 60

Modification of Gα Peptide at Cys-Asn-Leu-Lys-Glu-Asp-Gly-Ile-Ser-Ala-Ala-Lys-Asp-Val Preparation of maleimido peptides from peptides containing multiple protected functional groups and one cysteine is exemplified by the synthesis of a modified Gα peptide. The modified Gα peptide is synthesized by linking at an internal amino acid as described below.

In cases where a cysteine residue is contained within the peptide sequence and is not essentially to the biological activity of the peptide, this residue must be capped or replaced with another amino acid (e.g. alanine, methionine, etc.). Solid phase peptide synthesis of the modified Gα peptide on a 100 μmole scale is performed using manual solid-phase synthesis and a Symphony Peptide Synthesizer using Fmoc protected Rink Amide MBHA resin, Fmoc protected amino acids, O-benzotriazol-1-yl-N,N,N',N'-tetramethyluronium hexafluorophosphate (HBTU) in N,N-dimethylformamide (DMF) solution and activation with N-methyl morpholine (NMM), and piperidine deprotection of Fmoc groups (Step 1). The selective deprotection of the Lys(Aloc) group is performed manually and accomplished by treating the resin with a solution of 3 eq of $Pd(PPh_3)_4$ dissolved in 5 mL of $CHCl_3$:NMM:HOAc (18:1:0.5) for 2 h (Step 2). The resin is then washed with $CHCl_3$ (6×5 mL), 20% HOAc in DCM (6×5 mL), DCM (6×5 mL), and DMF (6×5 mL). The synthesis is then re-automated for the addition of 3-maleimidopropionic acid (Step 3). Resin cleavage and product isolation is performed using 85% TFA/5% TIS/5% thioanisole and 5% phenol, followed by precipitation by dry-ice cold $Et_2O$ (Step 4). The product is purified by preparative reversed phased HPLC using a Varian (Rainin) preparative binary HPLC system: gradient elution of 30–55% B (0.045% TFA in $H_2O$ (A) and 0.045% TFA in $CH_3CN$ (B)) over 180 min at 9.5 mL/min using a Phenomenex Luna 10μ phenyl-hexyl, 21 mm×25 cm column and UV detector (Varian Dynamax UVD II) at λ 214 and 254 nm to afford the desired DAC in >95% purity, as determined by RP-HPLC.

E. Preparation of Modified Peptides from Peptides Containing Two Cysteines In Disulfide Bridge Where the peptide contains two cysteines as a disulfide bridge, the peptide is cleaved from the support resin before addition of the maleimide. We need to add a Lys protected with a Mtt group in order to selectively deprotect the lysine in presence of other t-Boc protected lysine. All protecting groups are present except at the carboxy terminus (which stays unprotected due to cleavage from the support resin) and at the two cysteines, which need to be deprotected when peptide is cleaved from resin. Mild air oxidation yield the disulfide bridge, and the peptide can be purified at that stage. Solution phase chemistry is then required to activate the C-terminus in presence of the disulfide bridge and add the maleimide (through an amino-alkyl-maleimide) to the C-terminus. The peptide is then fully deprotected. Examples of therapeutic peptides that contain two cysteins as a disulfide bridge include human osteocalcin 1-49, human diabetes associated peptide, the 5-28 fragment of human/canine atrial natriuretic peptide, bovine bactenecin, and human [Tyr0]-cortistatin 29.

Preparation of maleimido peptides from therapeutic peptides containing two Cysteines in a disulfide bridge is exemplified by the synthesis of peptides as described below. The peptide may be modified at the N-terminus, the C-terminus, or at an amino acid located between the N-terminus and the C-terminus.

1. Modification at the N-Terminus

Example 61

Modification of TH-1 Peptide at N-Terminus

Preparation of (Nε-MPA)NH$_2$-Lys-Arg-Gly-Asp-Ala-Cys-Glu-Gly-Asp-Ser-Gly-Gly-Pro-Phe-Cys Preparation of thiol cyclized maleimido peptides from peptides containing multiple protected functional groups and no free cysteine residues (i.e. all cysteine residues are tied up as disulfide bridges) is illustrated by the synthesis of a modified TH-1 peptide.

Solid phase peptide synthesis of the modified TH-1 peptide on a 100 μmole scale was performed manually and on a Symphony Peptide Synthesizer using Fmoc protected Rink Amide MBHA resin, Fmoc protected amino acids, O-benzotriazol-1-yl-N,N,N',N'-tetramethyl-uronium hexafluorophosphate (HBTU) in N,N-dimethylformamide (DMF) solution and activation with N-methyl morpholine (NMM), and piperidine deprotection of Fmoc groups (Step 1). The removal of the Acm group and resulting oxidation of the two Cys residues to form the cyclized on resin DAC was accomplished using $Tl(CF_3CO)_2$ (Step 2). The deprotection of the terminal Fmoc group is accomplished using 20% piperidine followed by the coupling of 3-MPA (Step 3). Resin cleavage and product isolation was performed using 86% TFA/5% TIS/5% $H_2O$/2% thioanisole and 2% phenol, followed by precipitation by dry-ice cold $Et_2O$ (Step 4). The product was purified by preparative reverse phase HPLC using a Varian (Rainin) preparative binary HPLC system using a Dynamax $C_{18}$, 60 Å, 8 μm, 21 mm×25 cm column equipped with a Dynamax $C_{18}$, 60 Å, 8 μm guard module, 21 mm×25 cm column and UV detector (Varian Dynamax UVD II) at λ 214 and 254 nm. The product had >95% purity as determined by RP-HPLC mass spectrometry using a Hewlett Packard LCMS-1100 series spectrometer equipped with a diode array detector and using electro-spray ionization, ESI-MS m/z for $C_{66}H_{95}N_{20}O_{26}S_2$ (MH$^+$), 1646.8. Found: 1646.7. These steps are illustrated in the schematic diagram below.

Fmoc-Rink Amide MBHA Resin

[Step 1] SPPS

Fmoc-K(Boc)R(Pbf)GD(OtBu)AC(Acm)E(OtBu)GD(OtBu)S(tBu)GGPFC(Acm)-Resin

[Step 2]

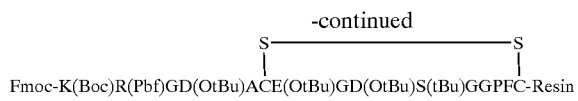

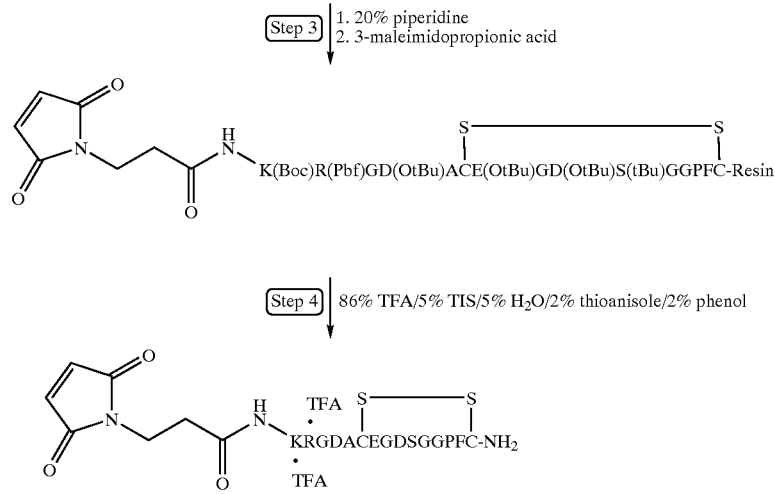

Example 62
Synthesis of N-MPA-Ser$^1$-Somatostatin-28

Solid phase peptide synthesis of the DAC:Somatostatin-28 analog on a 100 μmole scale is performed manually and on a Symphony Peptide Synthesizer using Fmoc protected Rink amide MBHA resin. The following protected amino acids are sequentially added to the resin: Fmoc-Cys(Acm)-OH, Fmoc-Ser(tBu)-OH, Fmoc-Thr(tBu)-OH, Fmoc-Phe-OH, Fmoc-Thr(tBu)-OH, Fmoc-Lys(Boc)-OH, Fmoc-Trp(Boc)-OH, Fmoc-Phe-OH, Fmoc-Phe-OH, Fmoc-Asn(Trt)-OH, Fmoc-Lys(Boc)-OH, Fmoc-Cys(Acm)-OH, Fmoc-Gly-OH, Fmoc-Ala-OH, Fmoc-Lys(Boc)-OH, Fmoc-Arg(Pbf)-OH, Fmoc-Glu(OtBu)-OH, Fmoc-Arg(Pbf)-OH, Fmoc-Pro-OH, Fmoc-Ala-OH, Fmoc-Met-OH, Fmoc-Ala-OH, Fmoc-Pro-OH, Fmoc-Asn(Trt)-OH, Fmoc-Ser(tBu)-OH, Fmoc-Asn(Trt)-OH, Fmoc-Ala-OH, Fmoc-Ser(tBu)-OH. They are dissolved in N,N-dimethylformamide (DMF) and, according to the sequence, activated using O-benzotriazol-1-yl-N,N,N',N'-tetramethyl-uronium hexafluorophosphate (HBTU) and Diisopropylethylamine (DIEA). Removal of the Fmoc protecting group is achieved using a solution of 20% (V/V) piperidine in N,N-dimethylformamide (DMF) for 20 minutes (Step 1). Removal of the Acm groups and resulting oxidation of the two Cys residues to form the disulfide bridge is accomplished using iodine (Step 2). Deprotection of the terminal Fmoc group is accomplished using 20% piperidine followed by the coupling of 3-MPA (Step 3). Resin cleavage and product isolation is performed using 86% TFA/5% TIS/5% H$_2$O/2% thioanisole and 2% phenol, followed by precipitation by dry-ice cold Et$_2$O (Step 4). The product is purified by preparative reversed phase HPLC using a Varian (Rainin) preparative binary HPLC system using a Dynamax C$_{18}$, 60 Å, 8 μm, 21 mm×25 cm column equipped with a Dynamax C$_{18}$, 60 Å, 8 μm guard module, 21 mm×25 cm column and UV detector (Varian Dynamax UVD II) at λ 214 and 254 nm to afford the desired DAC in >95% purity, as determined by RP-HPLC. These steps are illustrated in the schematic diagram below.

Fmoc-Rink Amide MBHA Resin

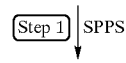 SPPS

Fmoc-SANSNPAMAPRERKAGC(Acm)KNFFWKTFTSC(Acm)-Resin

 I$_2$

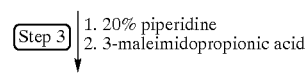

Fmoc-SANSNPAMAPRERKAGCKNFFWKTFTSC-Resin

Step 3 | 1. 20% piperidine
2. 3-maleimidopropionic acid

-continued

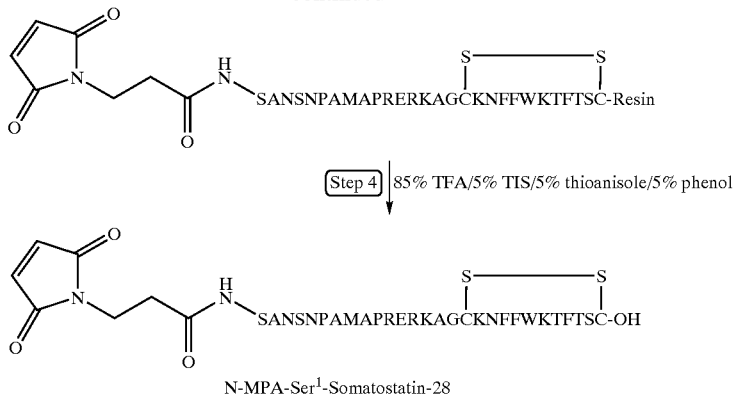

N-MPA-Ser[1]-Somatostatin-28

2. Modification at the C-Terminus

Example 63
Synthesis of Somatostatin-28-EDA-MPA

Solid phase peptide synthesis of the DAC:Somatostatin-28 analog on a 100 μmole scale is performed manually and on a Symphony Peptide Synthesizer using SASRIN (super acid sensitive resin). The following protected amino acids are sequentially added to the resin: Fmoc-Cys(Acm)-OH, Fmoc-Ser(tBu)-OH, Fmoc-Thr(tBu)-OH, Fmoc-Phe-OH, Fmoc-Thr(tBu)-OH, Fmoc-Lys(Boc)-OH, Fmoc-Trp(Boc)-OH, Fmoc-Phe-OH, Fmoc-Phe-OH, Fmoc-Asn(Trt)-OH, Fmoc-Lys(Boc)-OH, Fmoc-Cys(Acm)-OH, Fmoc-Gly-OH, Fmoc-Ala-OH, Fmoc-Lys(Boc)-OH, Fmoc-Arg(Pbf)-OH, Fmoc-Glu(OtBu)-OH, Fmoc-Arg(Pbf)-OH, Fmoc-Pro-OH, Fmoc-Ala-OH, Fmoc-Met-OH, Fmoc-Ala-OH, Fmoc-Pro-OH, Fmoc-Asn(Trt)-OH, Fmoc-Ser(tBu)-OH, Fmoc-Asn(Trt)-OH, Fmoc-Ala-OH, Boc-Ser(tBu)-OH. They are dissolved in N,N-dimethylformamide (DMF) and, according to the sequence, activated using O-benzotriazol-1-yl-N,N,N',N'-tetramethyl-uronium hexafluorophosphate (HBTU) and Diisopropylethylamine (DIEA). Removal of the Fmoc protecting group is achieved using a solution of 20% (V/V) piperidine in N,N-dimethylformamide (DMF) for 20 minutes (Step 1). The fully protected peptide is cleaved from the resin by treatment with 1% TFA/DCM (Step 2). Removal of the Acm groups and resulting oxidation of the two Cys residues to form the disulfide bridge is accomplished using iodine (Step 3). Ethylenediamine and 3-maleimidopropionic acid are then sequentially added to the free C-terminus (Step 4). The protecting groups are then cleaved and the product isolated using 86% TFA/5% TIS/5% $H_2O$/2% thioanisole and 2% phenol, followed by precipitation by dry-ice cold $Et_2O$ (Step 5). The product is purified by preparative reversed phase HPLC using a Varian (Rainin) preparative binary HPLC system using a Dynamax $C_{18}$, 60 Å, 8 μm, 21 mm×25 cm column equipped with a Dynamax $C_{18}$, 60 Å, 8 μm guard module, 21 mm×25 cm column and UV detector (Varian Dynamax UVD II) at λ 214 and 254 nm to afford the desired DAC in >95% purity, as determined by RP-HPLC. These steps are illustrated in the schematic diagram below.

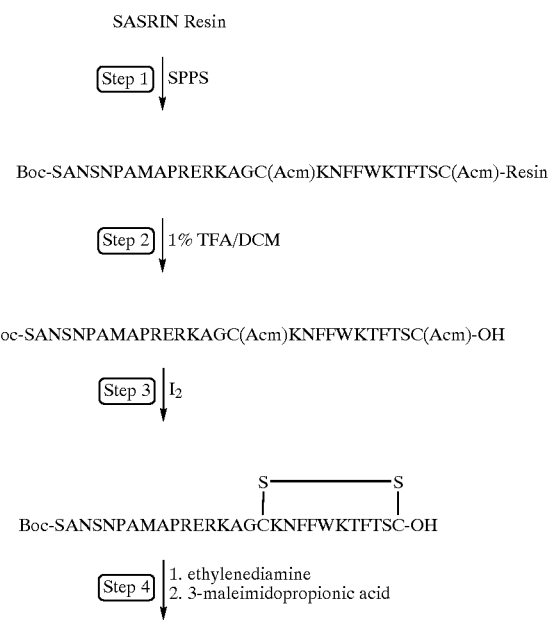

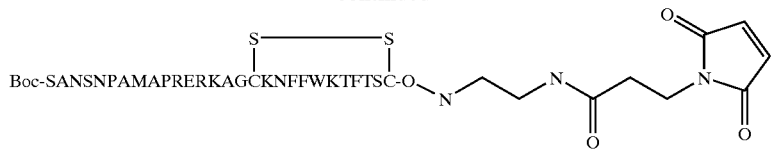

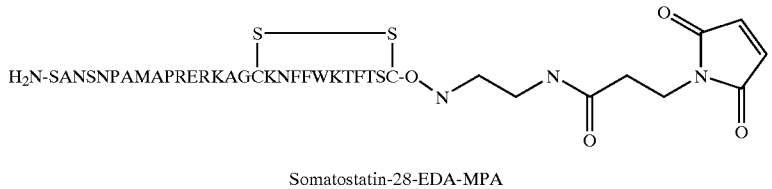

Somatostatin-28-EDA-MPA

3. Modification at an Internal Amino Acid

Example 64
Synthesis of Lys[14](ε-MPA)-Somatostatin-28

Solid phase peptide synthesis of the DAC:Somatostatin-28 analog on a 100 μmole scale is performed manually and on a Symphony Peptide Synthesizer using Fmoc protected Rink amide MBHA resin. The following protected amino acids are sequentially added to the resin: Fmoc-Cys(Acm)-OH, Fmoc-Ser(tBu)-OH, Fmoc-Thr(tBu)-OH, Fmoc-Phe-OH, Fmoc-Thr(tBu)-OH, Fmoc-Lys(Boc)-OH, Fmoc-Trp(Boc)-OH, Fmoc-Phe-OH, Fmoc-Phe-OH, Fmoc-Asn(Trt)-OH, Fmoc-Lys(Boc)-OH, Fmoc-Cys(Acm)-OH, Fmoc-Gly-OH, Fmoc-Ala-OH, Fmoc-Lys(Aloc)-OH, Fmoc-Arg(Pbf)-OH, Fmoc-Glu(OtBu)-OH, Fmoc-Arg(Pbf)-OH, Fmoc-Pro-OH, Fmoc-Ala-OH, Fmoc-Met-OH, Fmoc-Ala-OH, Fmoc-Pro-OH, Fmoc-Asn(Trt)-OH, Fmoc-Ser(tBu)-OH, Fmoc-Asn(Trt)-OH, Fmoc-Ala-OH, Fmoc-Ser(tBu)-OH. They are dissolved in N,N-dimethylformamide (DMF) and, according to the sequence, activated using O-benzotriazol-1-yl-N,N,N',N'-tetramethyl-uronium hexafluorophosphate (HBTU) and Diisopropylethylamine (DIEA). Removal of the Fmoc protecting group is achieved using a solution of 20% (V/V) piperidine in N,N-dimethylformamide (DMF) for 20 minutes (Step 1). Removal of the Acm groups and resulting oxidation of the two Cys residues to form the disulfide bridge is accomplished using iodine (Step 2). Selective deprotection of the Lys(Aloc) group is performed manually and accomplished by treating the resin with a solution of 3 eq of Pd(PPh$_3$)$_4$ dissolved in 5 mL of CHCl$_3$:NMM:HOAc (18:1:0.5) for 2 h (Step 3). The resin is then washed with CHCl$_3$ (6×5 mL), 20% HOAc in DCM (6×5 mL), DCM (6×5 mL), and DMF (6×5 mL). The synthesis is then re-automated for the addition of the 3-maleimidopropionic acid (Step 4). Resin cleavage and product isolation is performed using 86% TFA/5% TIS/5% H$_2$O/2% thioanisole and 2% phenol, followed by precipitation by dry-ice cold Et$_2$O (Step 5). The product is purified by preparative reversed phase HPLC using a Varian (Rainin) preparative binary HPLC system using a Dynamax C$_{18}$, 60 Å, 8 μm, 21 mm×25 cm column equipped with a Dynamax C$_{18}$, 60 Å, 8 μm guard module, 21 mm×25 cm column and UV detector (Varian Dynamax UVD II) at λ 214 and 254 nm to afford the desired DAC in >95% purity, as determined by RP-HPLC. These steps are illustrated in the following schematic diagram.

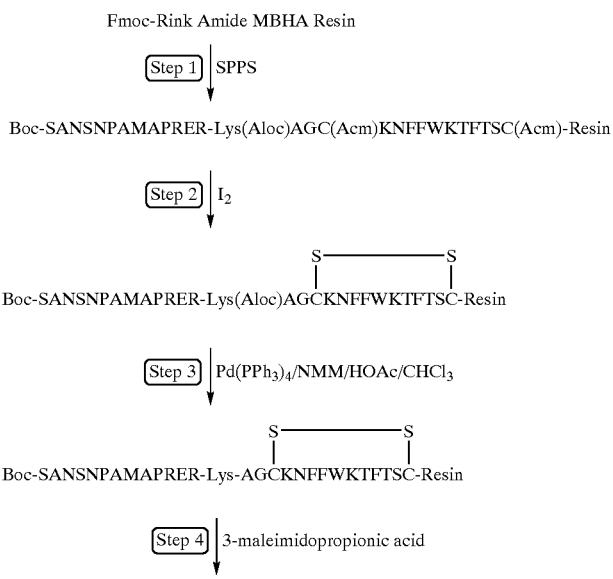

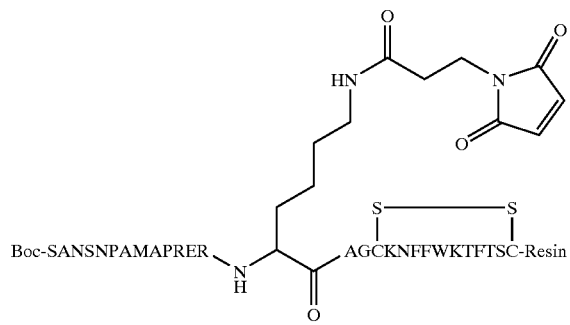

Boc-SANSNPAMAPRER ... AGCKNFFWKTFTSC-Resin

Step 5 | 85% TFA/5% TIS/5% thioanisole/5% phenol

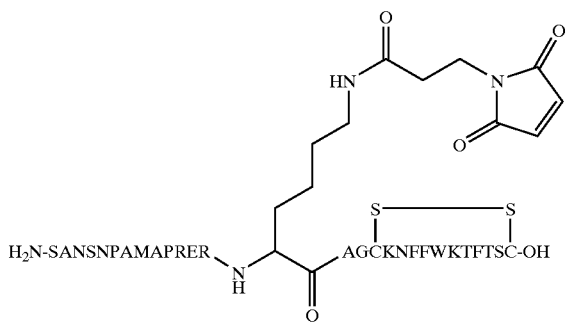

H$_2$N-SANSNPAMAPRER ... AGCKNFFWKTFTSC-OH

Lys$^{14}$(E-MPA)-Somatostatin-28

F. Preparation of Modified Peptides from Peptides Containing Multiple Cysteines
1. Modification at the N-Terminus Example 65

Synthesis of N-MPA-Cys$^1$-Endothelin-1 (1-21)-OH

Solid phase peptide synthesis of a modified Endothelin-1 analog on a 100 μmole scale is performed manually and on a Symphony Peptide Synthesizer using Fmoc protected Rink Amide MBHA resin. The following protected amino acids are sequentially added to the resin: Fmoc-Trp(Boc)-OH, Fmoc-Ile-OH, Fmoc-Ile-OH, Fmoc-Asp(OtBu)-OH, Fmoc-Leu-OH, Fmoc-His(Trt)-OH, Fmoc-Cys(Acm)-OH, Fmoc-Phe-OH, Fmoc-Tyr(tBu)-OH, Fmoc-Val-OH, Fmoc-Cys(tBu)-OH, Fmoc-Glu(OtBu)-OH, Fmoc-Lys(Boc)-OH, Fmoc-Asp(OtBu)-OH, Fmoc-Met-OH, Fmoc-Leu-OH, Fmoc-Ser(tBu)-OH, Fmoc-Ser(tBu)-OH, Fmoc-Cys(tBu)-OH, Fmoc-Ser(tBu)-OH, Fmoc-Cys(Acm)-OH. They are dissolved in N,N-dimethylformamide (DMF) and, according to the sequence, activated using O-benzotriazol-1-yl-N,N,N',N'-tetramethyl-uronium hexafluorophosphate (HBTU) and Diisopropylethylamine (DIEA). Removal of the Fmoc protecting groups is achieved using a solution of 20% (V/V) piperidine in N,N-dimethylformamide (DMF) for 20 minutes (Step 1). The removal of the Acm groups and resulting oxidation of the first two Cys residues to form the first disulfide bridge on resin is accomplished using iodine (Step 2). The removal of the tBu groups and resulting oxidation of the other two Cys residues to form the second disulfide bridge on resin is accomplished using thallium (III) trifluoroacetate (Step 3). The deprotection of the terminal Fmoc group is accomplished using 20% piperidine followed by the coupling of 3-MPA (Step 4). Resin cleavage and product isolation is performed using 86% TFA/5% TIS/5% H$_2$O/2% thioanisole and 2% phenol, followed by precipitation by dry-ice cold Et$_2$O (Step 5). The product is purified by

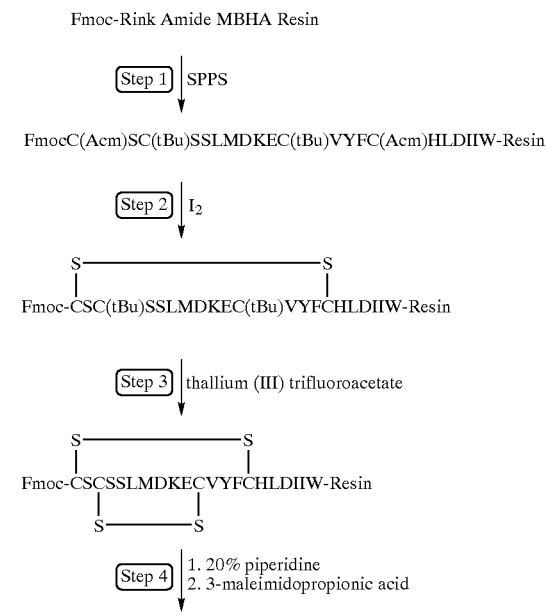

Fmoc-Rink Amide MBHA Resin

Step 1 | SPPS

FmocC(Acm)SC(tBu)SSLMDKEC(tBu)VYFC(Acm)HLDIIW-Resin

Step 2 | I$_2$

Fmoc-CSC(tBu)SSLMDKEC(tBu)VYFCHLDIIW-Resin
    S—————————————————S

Step 3 | thallium (III) trifluoroacetate

Fmoc-CSCSSLMDKECVYFCHLDIIW-Resin
    S—————————————————S
    |                 |
    S—————S Step 4 | 1. 20% piperidine
       2. 3-maleimidopropionic acid -continued

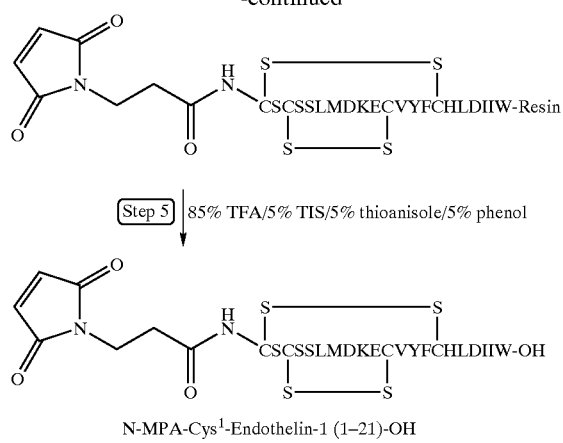

N-MPA-Cys[1]-Endothelin-1 (1–21)-OH preparative reverse phase HPLC using a Varian (Rainin) preparative binary HPLC system using a Dynamax $C_{18}$, 60 Å, 8 µm, 21 mm×25 cm column equipped with a Dynamax $C_{18}$, 60 Å, 8 µm guard module, 21 mm×25 cm column and UV detector (Varian Dynamax UVD II) at λ 214 and 254 nm to afford the desired DAC in >95% purity, as determined by RP-HPLC. These steps are illustrated in the schematic diagram above.

2. Modification at the C-Terminus

Example 66
Synthesis of Endothelin-1 (1-21)Lys[22]-(Nε-MPA)-OH

Solid phase peptide synthesis of a modified Endothelin-1 analog on a 100 µmole scale is performed manually and on a Symphony Peptide Synthesizer using Fmoc protected Rink Amide MBHA resin. The following protected amino acids are sequentially added to the resin: Fmoc-Lys(Aloc)-OH, Fmoc-Trp(Boc)-OH, Fmoc-Ile-OH, Fmoc-Ile-OH, Fmoc-Asp(OtBu)-OH, Fmoc-Leu-OH, Fmoc-His(Trt)-OH, Fmoc-Cys(Acm)-OH, Fmoc-Phe-OH, Fmoc-Tyr(tBu)-OH, Fmoc-Val-OH, Fmoc-Cys(tBu)-OH, Fmoc-Glu(OtBu)-OH, Fmoc-Lys(Boc)-OH, Fmoc-Asp(OtBu)-OH, Fmoc-Met-OH, Fmoc-Leu-OH, Fmoc-Ser(tBu)-OH, Fmoc-Ser(tBu)-OH, Fmoc-Cys(tBu)-OH, Fmoc-Ser(tBu)-OH, Boc-Cys(Acm)-OH. They are dissolved in N,N-dimethylformamide (DMF) and, according to the sequence, activated using O-benzotriazol-1-yl-N,N,N',N'-tetramethyl-uronium hexafluorophosphate (HBTU) and Diisopropylethylamine (DIEA). Removal of the Fmoc protecting group is achieved using a solution of 20% (V/V) piperidine in N,N-dimethylformamide (DMF) for 20 minutes (Step 1). The removal of the Acm groups and resulting oxidation of the first two Cys residues to form the first disulfide bridge on resin is accomplished using iodine (Step 2). The removal of the tBu groups and resulting oxidation of the other two Cys residues to form the second disulfide bridge on resin is accomplished using thallium (III) trifluoroacetate (Step 3). Selective deprotection of the Lys(Aloc) group is performed manually and accomplished by treating the resin with a solution of 3 eq of Pd(PPh3)4 dissolved in 5 mL of $CHCl_3$:NMM:HOAc (18:1:0.5) for 2 h (Step 4). The resin is then washed with CHCl3 (6×5 mL), 20% HOAc in DCM (6×5 mL), DCM (6×5 mL), and DMF (6×5 mL). The synthesis is then re-automated for the addition of the 3-maleimidopropionic acid (Step 5). Resin cleavage and product isolation is performed using 86% TFA/5% TIS/5% $H_2O$/2% thioanisole and 2% phenol, followed by precipitation by dry-ice cold $Et_2O$ (Step 5). The product is purified by preparative reverse phase HPLC using a Varian (Rainin) preparative binary HPLC system using a Dynamax $C_{18}$, 60 Å, 8 µm, 21 mm×25 cm column equipped with a Dynamax $C_{18}$, 60 Å, 8 µm guard module, 21 mm×25 cm column and UV detector (Varian Dynamax UVD II) at λ 214 and 254 nm to afford the desired DAC in >95% purity, as determined by RP-HPLC. These steps are illustrated in the schematic diagram below.

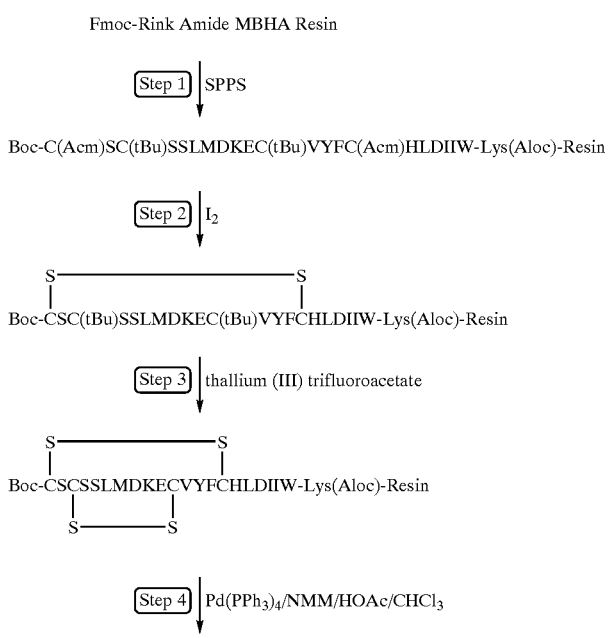

Boc-CSCSSLMDKECVYFCHLDIIW-Lys-Resin (with disulfide bridges: S—S between positions 1-3 and 11-15)

Step 5 | 3-maleimidopropionic acid

Boc-CSCSSLMDKECVYFCHLDIIW-[Lys(E-MPA)]-Resin

Step 6 | 85% TFA/5% TIS/5% thioanisole/5% phenol

H$_2$N-CSCSSLMDKECVYFCHLDIIW-[Lys(E-MPA)]-OH

Endothelin-1 (1–21) Lys$^{22}$(E-MPA)-OH

3. Modification at an Internal Amino Acid

Example 67

Synthesis of Lys$^4$(Nε-MPA)Sarafotoxin B(1-21)-OH

Solid phase peptide synthesis of a modified Sarafotoxin-B analog on a 100 μmole scale is performed manually and on a Symphony Peptide Synthesizer using Fmoc protected Rink Amide MBHA resin. The following protected amino acids are sequentially added to the resin: Fmoc-Trp(Boc)-OH, Fmoc-Ile-OH, Fmoc-Val-OH, Fmoc-Asp(OtBu)-OH, Fmoc-Gln(Trt)-OH, Fmoc-His(Trt)-OH, Fmoc-Cys(Acm)-OH, Fmoc-Phe-OH, Fmoc-Tyr(tBu)-OH, Fmoc-Leu-OH, Fmoc-Cys(tBu)-OH, Fmoc-Glu(OtBu)-OH, Fmoc-Lys(Boc)-OH, Fmoc-Asp(OtBu)-OH, Fmoc-Thr(tBu)-OH, Fmoc-Met-OH, Fmoc-Asp(OtBu)-OH, Fmoc-Lys(Aloc)-OH, Fmoc-Cys(tBu)-OH, Fmoc-Ser(tBu)-OH, Boc-Cys(Acm)-OH. They are dissolved in N,N-dimethylformamide (DMF) and, according to the sequence, activated using O-benzotriazol-1-yl-N,N,N',N'-tetramethyl-uronium hexafluorophosphate (HBTU) and Diisopropylethylamine (DIEA). Removal of the Fmoc protecting group is achieved using a solution of 20% (V/V) piperidine in N,N-dimethylformamide (DMF) for 20 minutes (Step 1). The removal of the Acm groups and resulting oxidation of the first two Cys residues to form the first disulfide bridge on resin is accomplished using iodine (Step 2). The removal of the tBu groups and resulting oxidation of the other two Cys residues to form the second disulfide bridge on resin is accomplished using thallium (III) trifluoroacetate (Step 3). Selective deprotection of the Lys (Aloc) group is performed manually and accomplished by treating the resin with a solution of 3 eq of Pd(PPh3)4 dissolved in 5 mL of CHCl$_3$:NMM:HOAc (18:1:0.5) for 2 h (Step 4). The resin is then washed with CHCl3 (6×5 mL), 20% HOAc in DCM (6×5 mL), DCM (6×5 mL), and DMF (6×5 mL). The synthesis is then re-automated for the addition of the 3-maleimidopropionic acid (Step 5). Resin cleavage and product isolation is performed using 86% TFA/5% TIS/5% H$_2$O/2% thioanisole and 2% phenol, followed by precipitation by dry-ice cold Et$_2$O (Step 5). The product is purified by preparative reverse phase HPLC using a Varian (Rainin) preparative binary HPLC system using a Dynamax C$_{18}$, 60 Å, 8 μm, 21 mm×25 cm column equipped with a Dynamax C$_{18}$, 60 Å, 8 μm guard module, 21 mm×25 cm column and UV detector (Varian Dynamax UVD II) at λ 214 and 254 nm to afford the desired DAC in >95% purity, as determined by RP-HPLC. These steps are illustrated in the schematic diagram below.

Fmoc-Rink Amide MBHA Resin

| Step 1 | SPPS
↓

Boc-C(Acm)SC(tBu)-Lys(Aloc)-DMTDKEC(tBu)LYFC(Acm)HQDVTW-Resin

| Step 2 | I$_2$
↓

```
    S——————————————S
    |              |
Boc-CSC(tBu)-Lys(Aloc)-DMTDKEC(tBu)LYFCHQDVIW-Resin
```

| Step 3 | thallium (III) trifluoroacetate
↓

```
    S——————————S
    |          |
Boc-CSC-Lys(Aloc)-DMTDKECLYFCHQDVIW-Resin
        |                  |
        S——————————————————S
```

| Step 4 | Pd(PPh$_3$)$_4$/NMM/HOAc/CHCl$_3$
↓

```
    S——————————S
    |          |
Boc-CSC-Lys-DMTDKECLYFCHQDVIW-Resin
        |            |
        S————————————S
```

| Step 5 | 3-maleimidopropionic acid
↓

Boc-CSC–[Lys(E-MPA)]–DMTDKECLYFCHQDVIW-Resin (with disulfide bridges)

| Step 6 | 85% TFA/5% TIS/5% thioanisole/5% phenol
↓

H$_2$N-CSC–[Lys(E-MPA)]–DMTDKECLYFCHQDVIW-Resin (with disulfide bridges)

Lys$^4$(E-MPA)Sarafotoxin B (1–21)-OH

F. Peptide Stability Assays

Example 68

Peptide Stability Assay of K5

A peptide stability assay was performed. (MPA)-Pro-Arg-Lys-Leu-Tyr-Asp-Lys-NH$_2$. 2TFA was synthesized as described above and was identified MPA-K5. The non-modified counterpart peptide Pro-Arg-Lys-Leu-Tyr-Asp-Lys was also synthesized as described in Example 20 without the addition of 3-MPA and identified as K5.

K5 (MW1260.18, 918.12 freebase) was prepared as a 100 mM stock solution in water. MPA-K5(MW=1411.17, 1069.11 freebase) was prepared as a 100 mM stock solution in water. Human Serum Albumin (HSA) was obtained as a 25% solution (ca 250 mg/ml, 3.75 mM) as Albutein® available from Alpha Therapeutic. Human plasma was obtained from Golden West Biologicals.

(1) Stability of K5 in Human Plasma

K5 was prepared as a 1 µM solution and dissolved in 25% human serum albumin. The mixture was then incubated at 37° C. in the presence of human plasma to final concentration of 160 mM K5. Aliquots of 100 µl were withdrawn from the plasma at 0, 4 hours and 24 hours. The 100 µl aliquots were mixed with 100 µl of blocking solution (5 vol. 5%ZnSO$_4$/3 vol. Acetonitrile/2 vol. Methanol) in order to precipitate all proteins. The sample was centrifuged for 5 min at 10,000 g and the supernatant containing the peptide was recovered and filtered through a 0.22 µm filter. The presence of free intact K5 peptide was assayed by the HPLC/MS. The results are presented below. The HPLC parameters for detection of K5 peptide in serum were as follows.

The HPLC method was as follows: A Vydac C18 250×4.6 mm, 5µ particle size column was utilized. The column temperature was 30° C. with a flow rate of 0.5 ml/min. Mobile Phase A was 0.1% TFA/water. Mobile Phase B was 0.1% TFA/acetonitrite. The injection volume was 10 µl.

The gradient was as follows:

| Time (Minutes) | % A | % B |
|---|---|---|
| 0 | 95 | 5 |
| 20 | 70 | 30 |
| 25 | 10 | 90 |
| 30 | 10 | 90 |
| 35 | 95 | 5 |
| 45 | 95 | 5 |

The proteins were detected at 214, 254 and 334 nm. For mass spectral analysis, the ionization mode was API-electrospray (positive mode) at an M/Z range of 300 to 2000. The gain was 3.0, fragmentor 120 v, threshold 20, stepsize 0.1. The gas temp was 350° C. and the drying gas volume was 10.0 l/min. The Neb pressure was 24 psi and the Vcap was 3500V. The HPLC method was as follows: A Vydac C18 250×4.6 mm, 5µ particle size column was utilized. The column temperature was 30° C. with a flow rate of 0.5 ml/min. Mobile Phase A was 0.1% TFA/water. Mobile Phase B was 0.1% TFA/acetonitrite. The injection volume was 10 µl.

The gradient was as follows:

| Time (Minutes) | % A | % B |
|---|---|---|
| 0 | 95 | 5 |
| 20 | 70 | 30 |
| 25 | 10 | 90 |
| 30 | 10 | 90 |
| 35 | 95 | 5 |
| 45 | 95 | 5 |

The proteins were detected at 214, 254 and 334 nm. For mass spectral analysis, the ionization mode was API-electrospray (positive mode) at an MEZ range of 300 to 2000. The gain was 3.0, fragmentor 120 v, threshold 20, stepsize 0.1. The gas temp was 350° C. and the drying gas volume was 10.0 l/min. The Neb pressure was 24 psi and the Vcap was 3500V.

| Time | % K5 peptide in Plasma |
|---|---|
| 0 hrs. | 100% |
| 4 hrs. | 9% |
| 24 hrs. | 0% |

The results demonstrate that unmodified K5 peptide is unstable in plasma likely as a result of protease activity.

(2) Stability of MPA-K5-HSA Conjugate in Plasma

MPA-K5 (modified K5 peptide) was incubated with 25% HSA for 2 hours at room temperature. The MPA-K5-HSA conjugate was then incubated at 37° in the presence of human plasma at a final concentration of 160 µm. After the specific incubation period (0, 4 and 24 hours) an aliquot of 100 µl was withdrawn and filtered through a 0.22 µm filter. The presence of intact conjugate was assayed by HPLC-MS.

The column was an Aquapore RP-300, 250×4.6 mm, 7µ particle size. The column temperature was 50° C. The mobile phase A was 0.1% TFA/water. The mobile phase B was 0.1% TFA/acetonitrile. The injection volume was 1 µl. The gradient was as follows:

| Time (minutes) | % A | % B | Flow (ml/min) |
|---|---|---|---|
| 0 | 56 | 34 | 0.700 |
| 1 | 66 | 34 | 0.700 |
| 25 | 58.8 | 41.2 | 0.700 |
| 30 | 50 | 50 | 0.70 |
| 35 | 5 | 95 | 1.00 |
| 41 | 5 | 95 | 1.00 |
| 45 | 66 | 34 | 1.00 |
| 46 | 66 | 34 | 0.70 |

The peptide was detected at 214 mm for quantification. For mass spectral analysis of the peptide, the ionization mode was API-electrospray at 1280 to 1500 m/z range, gain 1.0, fragmentor 125V, threshold 100, stepsize 0.40. The gas temperature was 350° C. the drying gas was 13.0 l/min. The pressure was 60 psi and the Vcap was 6000V. The results are presented below.

Approximately 33% of circulating albumin in the bloodstream is mercaptalbumin (SH-albumin) which is not blocked by endogenous sulfhydryl compounds such as cysteine or glutathione and is therefore available for reaction with maleimido groups. The remaining 66% of the circulating albumin is capped or blocked by sulfhydryl compounds. The HPLC MS assay permits the identification of capped-HSA, SH-albumin and K5MPA-albumin. The MPA covalently bonds to the free thiol on the albumin. The stability of the three forms of albumin in plasma is presented below.

| Time    | % capped HSA | % SH-Albumin | % K5-MPA-HSA |
|---------|--------------|--------------|--------------|
| 0 hrs.  | 61.3         | 16.6         | 22.1         |
| 4 hrs.  | 64.6         | 16.05        | 19.35        |
| 24 hrs. | 63           | 16.8         | 20.2         |

The percentage of K5-MPA-HSA remained relatively constant throughout the 24 hour plasma assay in contrast to unmodified K5 which decreased to 9% of the original amount of K5 in only 4 hours in plasma. The results demonstrate that in contrast to K5 which is quite unstable in plasma, K5-MPA-HSA is quite stable from peptidase activity in plasma.

Example 70
Peptide Stability Assay of Dynorphin

In order to determine the stability of peptide conjugates in the presence of serum peptidases the serum stability of Dyn A-(1-13)-OH, Dyn A-(1-13)-$NH_2$ and Dyn A 1-13(MPA)-$NH_2$ were compared. Dyn A-(1-13)-OH, Dyn A-(1-13)-$NH_2$ and Dyn A 1-13(MPA)$NH_2$ were synthesized as described above. The Dynorphin peptides were mixed with human heparinized plasma to a final concentration of 4 mg/mL. After the required incubation time at 37° C., 0, 20, 20, 60, 120, 180, 360 and 480 minutes) a 100 μL-aliquot was added to 100 μL of blocking solution (5 vol. of a 5% aqueous $ZnSO_4$ solution, 3 vol. of acetonitrile, 2 vol. of methanol) that precipitates all proteins. After centrifugation (10,000 g for 2.5 min), clear supernatant was recovered, filtered through a 0.45 μm filter and stored on ice until LC/MS analysis.

The samples were analyzed using an LC at 214 nm to detect the presence of the different compounds and MS to determine the identity of the detected compound. The integrated area % for each peak from the LC chromatogram was then plotted against time and the relative stabilities determined in human plasma.

The stability data for Dyn A-(1-1 3)-OH and Dyn A-(1-1 3)-$NH_2$ were consistent with that reported in literature: the proteolytic breakdown of the dynorphin peptides is quite rapid. Dyn A-(1-13)-OH had a half life of about 10 minutes. Dyn A-(1-13)-$NH_2$ had a half life of about 30 minutes. In contrast Dyn A 1-13(MPA)-$NH_2$ exhibited striking stabilization in the presence of serum peptidase activity. Unmodified dynorphin peptides are degraded within 60 minutes. In contrast, modified dynorphin peptides (Dyn A 1-13(MPA)-$NH_2$) are stable from serum peptidase activity for up to 480 minutes.

The stability determination of the dynorphin conjugate is determined by ELISA. In order to determine if the observed signal is due to a dynorphin conjugate and what the conjugate is, LC mass spectrometrytral analysis of the reaction mixture after 8 h was performed. The use of mass spectrometry permits a determination of the molecular weight of the conjugate and allows the determination whether there are any truncated forms of the dynorphin conjugate. Mass spectrometry of human plasma shows the two forms of albumin, the free thiol at 66436 Da and the oxidized form at 66557 Da. Also, mass spectrometry can distinguish between a Dyn 2-13 truncated conjugate (68046 Da) and the intact Dyn 1-13 conjugate, (68207 Da) in an equal mixture.

Mass spectrometry analysis of dynorphin samples taken from the serum after 480 minutes of exposure to the serum peptidases identifies only the presence of the intact conjugate (68192 Da) and not the breakdown products thereby demonstrating the stability of the dynorphin conjugate from serum peptidase activity.

TABLE 1

NATURAL AMINO ACIDS AND THEIR ABBREVIATIONS

| Name          | 3-Letter Abbreviation | 1-Letter Abbreviation | Protected Amino Acids |
|---------------|-----------------------|-----------------------|-----------------------|
| Alanine       | Ala                   | A                     | Fmoc-Ala-OH           |
| Arginine      | Arg                   | R                     | Fmoc-Arg(Pbf)-OH      |
| Asparagine    | Asn                   | N                     | Fmoc-Asn(Trt)-OH      |
| Aspartic acid | Asp                   | D                     | Asp(tBu)-OH           |
| Cysteine      | Cys                   | C                     | Fmoc-Cys(Trt)         |
| Glutamic acid | Glu                   | E                     | Fmoc-Glu(tBu)-OH      |
| Glutamine     | Gln                   | Q                     | Fmoc-Gln(Trt)-OH      |
| Glycine       | Gly                   | G                     | Fmoc-Gly-OH           |
| Histidine     | His                   | H                     | Fmoc-His(Trt)-OH      |
| Isoleucine    | Ile                   | I                     | Fmoc-Ile-OH           |
| Leucine       | Leu                   | L                     | Fmoc-Leu-OH           |
| Lysine        | Lys                   | K                     | Fmoc-Lys(Mtt)-OH      |
| Methionine    | Met                   | M                     | Fmoc-Met-OH           |
| Phenylalanine | Phe                   | F                     | Fmoc-Phe-OH           |
| Proline       | Pro                   | P                     | Fmoc-Pro-OH           |
| Serine        | Ser                   | S                     | Fmoc-Ser(tBu)-OH      |
| Threonine     | Thr                   | T                     | Fmoc-Thr(tBu)-OH      |
| Tryptophan    | Trp                   | W                     | Fmoc-Trp(Boc)-OH      |
| Tyrosine      | Tyr                   | Y                     | Boc-Tyr(tBu)-OH       |
| Valine        | Val                   | V                     | Fmoc-Val-OH           |

SEQUENCE LISTING (1617 sequences)

SEQ ID NO: 1 - protein, 19 aa, Artificial Sequence
  Description of Artificial Sequence: Synthetic Peptide
HFRWGKPVGKKRRPVKVYP

SEQ ID NO: 2 - protein, 8 aa, Artificial Sequence
  Description of Artificial Sequence: Synthetic Peptide
MEHFRWGK

SEQ ID NO: 3 - protein, 39 aa, Artificial Sequence
  Description of Artificial Sequence: Synthetic Peptide
SYSMEHFRWGKPVGKKRRPVKVYPNGAEDESAEAFPLEF

SEQ ID NO: 4 - protein, 13 aa, Artificial Sequence
  Description of Artificial Sequence: Synthetic Peptide
SYSMEHFRWGKPV

SEQ ID NO: 5 - protein, 16 aa, Artificial Sequence
  Description of Artificial Sequence: Synthetic Peptide
SYSMEHFRWGKPVGKK

SEQ ID NO: 6 - protein, 17 aa, Artificial Sequence
  Description of Artificial Sequence: Synthetic Peptide
SYSMEHFRWGKPVGKKR

SEQ ID NO: 7 - protein, 24 aa, Artificial Sequence
  Description of Artificial Sequence: Synthetic Peptide
SYSMEHFRWGKPVGKKRRPVKVYP

SEQ ID NO: 8 - protein, 7 aa, Artificial Sequence
  Description of Artificial Sequence: Synthetic Peptide
MEHFRWG

SEQ ID NO: 9 - protein, 32 aa, Artificial Sequence
  Description of Artificial Sequence: Synthetic Peptide
FRWGKPVGKKRRPVKVYPNGAEDESAEAFPLE

SEQ ID NO: 10 - protein, 22 aa, Artificial Sequence
  Description of Artificial Sequence: Synthetic Peptide
RPVKVYPNGAEDESAEAFPLEF

SEQ ID NO: 11 - protein, 39 aa, Artificial Sequence
  Description of Artificial Sequence: Synthetic Peptide
SYSMEHFRWGKPVGKKRRPVKVYPNVAENESAEAFPLEF

SEQ ID NO: 12 - protein, 28 aa, Artificial Sequence
  Description of Artificial Sequence: Synthetic Peptide
PVGKKRRPVKVYPNVAENESAEAFPLEF

SEQ ID NO: 13 - protein, 18 aa, Artificial Sequence
  Description of Artificial Sequence: Synthetic Peptide
VYPNGAEDESAEAFPLEF

SEQ ID NO: 14 - protein, 39 aa, Artificial Sequence; identical to SEQ ID NO: 11
  Description of Artificial Sequence: Synthetic Peptide

SEQ ID NO: 15 - protein, 28 aa, Artificial Sequence
  Description of Artificial Sequence: Synthetic Peptide
PVGKKRRPVKVYPNVAENESAEAFPLEF

SEQ ID NO: 16 - protein, 18 aa, Artificial Sequence
  Description of Artificial Sequence: Synthetic Peptide
VYPNGAEDESAEAFPLEF

SEQ ID NO: 17 - protein, 33 aa, Artificial Sequence
  Description of Artificial Sequence: Synthetic Peptide
VCSCRLVFCRRTELRVGNCLIGGVSFTYCCTRV

SEQ ID NO: 18 - protein, 34 aa, Artificial Sequence
  Description of Artificial Sequence: Synthetic Peptide
GICACRRRFCPNSERFSGYCRVNGARYVRCCSRR

SEQ ID NO: 19 - protein, 5 aa, Artificial Sequence
  Description of Artificial Sequence: Synthetic Peptide
MEHFF

SEQ ID NO: 20 - protein, 5 aa, Artificial Sequence
  Description of Artificial Sequence: Synthetic Peptide
MEHFF

SEQ ID NO: 21 - protein, 17 aa, Artificial Sequence
  Description of Artificial Sequence: Synthetic Peptide
SYSMEHFRWGKPVGKKR

SEQ ID NO: 22 - protein, 30 aa, Artificial Sequence
  Description of Artificial Sequence: Synthetic Peptide
RKYVMGHFRWDRFGRRNSSSSGSSGAGQKR

SEQ ID NO: 23 - protein, 43 aa, Artificial Sequence
  Description of Artificial Sequence: Synthetic Peptide
FPTIPLSRLFDNAMLRAHRLHQLAFDTYQEFEEAYIPKEQKYS

SEQ ID NO: 24 - protein, 8 aa, Artificial Sequence
  Description of Artificial Sequence: Synthetic Peptide
LSRLFDNA

SEQ ID NO: 25 - protein, 9 aa, Artificial Sequence
  Description of Artificial Sequence: Synthetic Peptide
CEHRWCKPV

SEQ ID NO: 26 - protein, 13 aa, Artificial Sequence
  Description of Artificial Sequence: Synthetic Peptide
SYSMEHFRWGKPV

SEQ ID NO: 27 - protein, 13 aa, Artificial Sequence
  Description of Artificial Sequence: Synthetic Peptide
SYSMEHFRWGKPV

SEQ ID NO: 28 - protein, 18 aa, Artificial Sequence
  Description of Artificial Sequence: Synthetic Peptide
DEGPYKMEHFRWGSPPKD

SEQ ID NO: 29 - protein, 13 aa, Artificial Sequence
  Description of Artificial Sequence: Synthetic Peptide
SYSMEHFRWGKPV

SEQ ID NO: 30 - protein, 12 aa, Artificial Sequence
  Description of Artificial Sequence: Synthetic Peptide
SYSMEHRWGKPV

SEQ ID NO: 31 - protein, 11 aa, Artificial Sequence
  Description of Artificial Sequence: Synthetic Peptide
YVMGHFRWDRF

SEQ ID NO: 32 - protein, 12 aa, Artificial Sequence
  Description of Artificial Sequence: Synthetic Peptide
KYVMGHFRWDRF

SEQ ID NO: 33 - protein, 3 aa, Artificial Sequence
  Description of Artificial Sequence: Synthetic Peptide
PLG

SEQ ID NO: 34 - protein, 6 aa, Artificial Sequence
  Description of Artificial Sequence: Synthetic Peptide
DHFRWK

SEQ ID NO: 35 - protein, 12 aa, Artificial Sequence
  Description of Artificial Sequence: Synthetic Peptide
SYSEHFRWGKPV

SEQ ID NO: 36 - protein, 12 aa, Artificial Sequence
  Description of Artificial Sequence: Synthetic Peptide
SYSEHFRWGKPV

SEQ ID NO: 37 - protein, 6 aa, Artificial Sequence
  Description of Artificial Sequence: Synthetic Peptide
EHFRWG

SEQ ID NO: 38 - protein, 22 aa, Artificial Sequence
  Description of Artificial Sequence: Synthetic Peptide
AEKKDEGPYRMEHFRWGSPPKD

SEQ ID NO: 39 - protein, 12 aa, Artificial Sequence
  Description of Artificial Sequence: Synthetic Peptide
YVMGHFRWDRFG

SEQ ID NO: 40 - protein, 7 aa, Artificial Sequence
  Description of Artificial Sequence: Synthetic Peptide
YIQNPLG

SEQ ID NO: 41 - protein, 9 aa, Artificial Sequence
  Description of Artificial Sequence: Synthetic Peptide
CYIQNCPLG

SEQ ID NO: 42 - protein, 7 aa, Artificial Sequence
  Description of Artificial Sequence: Synthetic Peptide
YITNCPY

SEQ ID NO: 43 - protein, 6 aa, Artificial Sequence
  Description of Artificial Sequence: Synthetic Peptide
CYIQNC

SEQ ID NO: 44 - protein, 9 aa, Artificial Sequence
  Description of Artificial Sequence: Synthetic Peptide
CYIQNCPLG

SEQ ID NO: 45 - protein, 9 aa, Artificial Sequence
  Description of Artificial Sequence: Synthetic Peptide
MNIKGSPWK

SEQ ID NO: 46 - protein, 7 aa, Artificial Sequence
  Description of Artificial Sequence: Synthetic Peptide
YFQNPRG

SEQ ID NO: 47 - protein, 7 aa, Artificial Sequence
  Description of Artificial Sequence: Synthetic Peptide
YIQNPRG

SEQ ID NO: 48 - protein, 9 aa, Artificial Sequence
  Description of Artificial Sequence: Synthetic Peptide
CYFQNCPKG

SEQ ID NO: 49 - protein, 6 aa, Artificial Sequence
  Description of Artificial Sequence: Synthetic Peptide
CYFQNC

SEQ ID NO: 50 - protein, 7 aa, Artificial Sequence
  Description of Artificial Sequence: Synthetic Peptide
YFVNCPG

SEQ ID NO: 51 - protein, 7 aa, Artificial Sequence
  Description of Artificial Sequence: Synthetic Peptide
YFQNCPR

SEQ ID NO: 52 - protein, 9 aa, Artificial Sequence
  Description of Artificial Sequence: Synthetic Peptide
CYFQNCPRG

SEQ ID NO: 53 - protein, 8 aa, Artificial Sequence
  Description of Artificial Sequence: Synthetic Peptide
CYFQNCPR

SEQ ID NO: 54 - protein, 9 aa, Artificial Sequence
  Description of Artificial Sequence: Synthetic Peptide
CYFQNCPRG

SEQ ID NO: 55 - protein, 8 aa, Artificial Sequence
  Description of Artificial Sequence: Synthetic Peptide
YFQNCPRG

SEQ ID NO: 56 - protein, 8 aa, Artificial Sequence
  Description of Artificial Sequence: Synthetic Peptide
YFQNCPRG

SEQ ID NO: 57 - protein, 8 aa, Artificial Sequence
  Description of Artificial Sequence: Synthetic Peptide
AFQNCPRG

SEQ ID NO: 58 - protein, 7 aa, Artificial Sequence
  Description of Artificial Sequence: Synthetic Peptide
YFVNCPG

SEQ ID NO: 59 - protein, 8 aa, Artificial Sequence
  Description of Artificial Sequence: Synthetic Peptide
YFQNCPRY

SEQ ID NO: 60 - protein, 7 aa, Artificial Sequence
  Description of Artificial Sequence: Synthetic Peptide
IFINCPR

SEQ ID NO: 61 - protein, 8 aa, Artificial Sequence
  Description of Artificial Sequence: Synthetic Peptide
YFVNCPRG

SEQ ID NO: 62 - protein, 8 aa, Artificial Sequence
  Description of Artificial Sequence: Synthetic Peptide
YFQNCPRG

SEQ ID NO: 63 - protein, 6 aa, Artificial Sequence
  Description of Artificial Sequence: Synthetic Peptide
ENCCPR

SEQ ID NO: 64 - protein, 8 aa, Artificial Sequence
  Description of Artificial Sequence: Synthetic Peptide
FFINCPRA

SEQ ID NO: 65 - protein, 7 aa, Artificial Sequence
  Description of Artificial Sequence: Synthetic Peptide
YFQNCPK

SEQ ID NO: 66 - protein, 8 aa, Artificial Sequence
  Description of Artificial Sequence: Synthetic Peptide
FFINCPRA

SEQ ID NO: 67 - protein, 9 aa, Artificial Sequence
  Description of Artificial Sequence: Synthetic Peptide
CYFQNCPKG

SEQ ID NO: 68 - protein, 7 aa, Artificial Sequence
  Description of Artificial Sequence: Synthetic Peptide
YFVNCPG

SEQ ID NO: 69 - protein, 8 aa, Artificial Sequence
  Description of Artificial Sequence: Synthetic Peptide
CFIQNCPG

SEQ ID NO: 70 - protein, 9 aa, Artificial Sequence
  Description of Artificial Sequence: Synthetic Peptide
CYIQNCPRG

SEQ ID NO: 71 - protein, 7 aa, Artificial Sequence
  Description of Artificial Sequence: Synthetic Peptide
YIQNCPG

SEQ ID NO: 72 - protein, 25 aa, Artificial Sequence
  Description of Artificial Sequence: Synthetic Peptide
SEAAALPRASAAAMRAAWPSPSVEG

SEQ ID NO: 73 - protein, 28 aa, Artificial Sequence
  Description of Artificial Sequence: Synthetic Peptide
FHLLREVLEARAEQLAQEAHKNRKLEII

SEQ ID NO: 74 - protein, 30 aa, Artificial Sequence
  Description of Artificial Sequence: Synthetic Peptide
FHLLREMLEMAKAEQEAEQAALNRLLLEEA

SEQ ID NO: 75 - protein, 41 aa, Artificial Sequence
  Description of Artificial Sequence: Synthetic Peptide
SQEPPISLDLTFHLLREVLEMTKADQLAQQAHNNRKLLDIA

SEQ ID NO: 76 - protein, 41 aa, Artificial Sequence
  Description of Artificial Sequence: Synthetic Peptide
SEEPPISLDLTFHLLREVLEMARAEQLAQQAHSNRKLMEII

SEQ ID NO: 77 - protein, 41 aa, Artificial Sequence
  Description of Artificial Sequence: Synthetic Peptide
SQEPPISLDLTFHLLREVLEMTKADQLAQQAHSNRKLLDIA

SEQ ID NO: 78 - protein, 41 aa, Artificial Sequence
  Description of Artificial Sequence: Synthetic Peptide
SEEPPISLDLTFHLLREVLEMARAEQLAQQAHSNRKLMENF

SEQ ID NO: 79 - protein, 21 aa, Artificial Sequence
  Description of Artificial Sequence: Synthetic Peptide
SEEPPISLDLTFHLLREVLEC

SEQ ID NO: 80 - protein, 33 aa, Artificial Sequence
  Description of Artificial Sequence: Synthetic Peptide
DLTFHLLREMLEMAKAEQEAEQAALNRLLLEEA

SEQ ID NO: 81 - skipped

SEQ ID NO: 82 - protein, 28 aa, Artificial Sequence
  Description of Artificial Sequence: Synthetic Peptide
FHLLREVLEARAEQLAQQAHSNRKLEII

SEQ ID NO: 83 - protein, 28 aa, Artificial Sequence
  Description of Artificial Sequence: Synthetic Peptide
FHLLREVLEARAEQLAQEAHKNRKLEII

SEQ ID NO: 84 - protein, 40 aa, Artificial Sequence
  Description of Artificial Sequence: Synthetic Peptide
SEEPISLDLTFHLLREVLEMARAEQLAQQAHSNRKLMEII

SEQ ID NO: 85 - protein, 4 aa, Artificial Sequence
  Description of Artificial Sequence: Synthetic Peptide
VGSE

SEQ ID NO: 86 - protein, 4 aa, Artificial Sequence
  Description of Artificial Sequence: Synthetic Peptide
AGSE

SEQ ID NO: 87 - protein, 41 aa, Artificial Sequence; identical to SEQ ID NO: 77
  Description of Artificial Sequence: Synthetic Peptide

SEQ ID NO: 88 - protein, 40 aa, Artificial Sequence
  Description of Artificial Sequence: Synthetic Peptide
SQEPPISLDLTFHLLREVLETKADQLAQQAYSNRKLLDIA

SEQ ID NO: 89 - protein, 27 aa, Artificial Sequence
  Description of Artificial Sequence: Synthetic Peptide
SLDSPAALAERGARNALGGHQEAPERE

SEQ ID NO: 90 - protein, 40 aa, Artificial Sequence
  Description of Artificial Sequence: Synthetic Peptide
EGPPISIDLSLELLRKMIEIEKQEKEKQQAANNRLLLDTI

SEQ ID NO: 91 - protein, 42 aa, Artificial Sequence
  Description of Artificial Sequence: Synthetic Peptide
YSEEPPISLDLTFHLLREVLEMARAEQLAQQAHSNRKLMEII

SEQ ID NO: 92 - protein, 42 aa, Artificial Sequence
  Description of Artificial Sequence: Synthetic Peptide
YSQEPPISLDLTFHLLREVLEMTKADQLAQQAHSNRKLLDIA

SEQ ID NO: 93 - protein, 9 aa, Artificial Sequence
  Description of Artificial Sequence: Synthetic Peptide
YNRKLLDIA

SEQ ID NO: 94 - protein, 41 aa, Artificial Sequence
  Description of Artificial Sequence: Synthetic Peptide
YDDPPLSIDLTFHLLRTLLELARTQSQRERAEQNRIIFDSV

SEQ ID NO: 95 - protein, 41 aa, Artificial Sequence; identical to SEQ ID NO: 94
  Description of Artificial Sequence: Synthetic Peptide

SEQ ID NO: 96 - protein, 40 aa, Artificial Sequence
  Description of Artificial Sequence: Synthetic Peptide
DNPPLSIDLTFHLLRTLLELARTQSQRERAEQNRIIFDSV

SEQ ID NO: 97 - protein, 40 aa, Artificial Sequence
  Description of Artificial Sequence: Synthetic Peptide
DDPPLSIDLTFHLLRTLLELARTQSQRERAEQNRIIFDSV

SEQ ID NO: 98 - protein, 41 aa, Artificial Sequence
  Description of Artificial Sequence: Synthetic Peptide
NDDPPISIDLTFHLLRNMIEMARIENEREQAGLNRKYLDEV

SEQ ID NO: 99 - protein, 12 aa, Artificial Sequence
  Description of Artificial Sequence: Synthetic Peptide
AGTADCFWKYCV

SEQ ID NO: 100 - protein, 13 aa, Artificial Sequence
  Description of Artificial Sequence: Synthetic Peptide
AGNLSECFWKYCV

SEQ ID NO: 101 - protein, 46 aa, Artificial Sequence
  Description of Artificial Sequence: Synthetic Peptide
TGSGPSLSIVNPLDVLRQRLLLEIARRRMRQSQDQIQANREILQTI

SEQ ID NO: 102 - protein, 41 aa, Artificial Sequence
  Description of Artificial Sequence: Synthetic Peptide
SEDPPMSIDLTFHMLRNMIHMAKMEGEREQAQINRNLLDEV

SEQ ID NO: 103 - protein, 29 aa, Artificial Sequence
  Description of Artificial Sequence: Synthetic Peptide
FECTTHQPRSPLRDLKGALESLIEEETGQ

SEQ ID NO: 104 - protein, 29 aa, Artificial Sequence
  Description of Artificial Sequence: Synthetic Peptide
FECTTHQPRSPLRDLKGALESLIEEETGQ

SEQ ID NO: 105 - protein, 13 aa, Artificial Sequence
  Description of Artificial Sequence: Synthetic Peptide
DAENLIDSFQEIV

SEQ ID NO: 106 - protein, 13 aa, Artificial Sequence
  Description of Artificial Sequence: Synthetic Peptide
NTEHLVDSFQEMG

SEQ ID NO: 107 - protein, 13 aa, Artificial Sequence
  Description of Artificial Sequence: Synthetic Peptide
DTSHHDQDHPTFD

SEQ ID NO: 108 - skipped

SEQ ID NO: 109 - protein, 26 aa, Artificial Sequence
  Description of Artificial Sequence: Synthetic Peptide
WCLESSQCQDLSTESNLLACIRACKP

SEQ ID NO: 110 - protein, 10 aa, Artificial Sequence
  Description of Artificial Sequence: Synthetic Peptide
QHWSYGLSPG

SEQ ID NO: 111 - protein, 44 aa, Artificial Sequence
  Description of Artificial Sequence: Synthetic Peptide
YADAIFTNSYRKVLGQLSARKLLQDIMSRQQGESNQERGARARL

SEQ ID NO: 112 - protein, 44 aa, Artificial Sequence
  Description of Artificial Sequence: Synthetic Peptide
YADAIFTNSYRKVLGQLSARKLLQDIMNRQQGERNQEQGAKVRL

SEQ ID NO: 113 - protein, 44 aa, Artificial Sequence
  Description of Artificial Sequence: Synthetic Peptide
YADAIFTNSYRKVLGQLSARKLLQDIMSRQQGERNQEQGARVRL

SEQ ID NO: 114 - protein, 29 aa, Artificial Sequence
  Description of Artificial Sequence: Synthetic Peptide
HADAIFTSSYRRILGQLYARKLLHEIMNR

SEQ ID NO: 115 - protein, 30 aa, Artificial Sequence
  Description of Artificial Sequence: Synthetic Peptide
VDSMWAEQKQMELESILVALLQKHSRNSQG

SEQ ID NO: 116 - protein, 29 aa, Artificial Sequence
  Description of Artificial Sequence: Synthetic Peptide
YADAIFTNSYRKVLGQLSARKLLQDIMSR

SEQ ID NO: 117 - protein, 29 aa, Artificial Sequence
  Description of Artificial Sequence: Synthetic Peptide
YADAIFTNSYRKVLGQLSARKLLQDIMSR

SEQ ID NO: 118 - protein, 29 aa, Artificial Sequence
  Description of Artificial Sequence: Synthetic Peptide
YRDAIFTNSYRKVLGQLSARKLLQDIMSR

SEQ ID NO: 119 - protein, 31 aa, Artificial Sequence
  Description of Artificial Sequence: Synthetic Peptide
HADAIFTNSYRKVLGQLSARKLLQDISRQQG

SEQ ID NO: 120 - protein, 37 aa, Artificial Sequence
  Description of Artificial Sequence: Synthetic Peptide
YADAIFTNSYRKVLGQLSARKLLQDIMSRQQGESNQE

SEQ ID NO: 121 - protein, 40 aa, Artificial Sequence
  Description of Artificial Sequence: Synthetic Peptide
YADAIFTNSYRKVLGQLSARKLLQDIMSRQQGESNQERGA

SEQ ID NO: 122 - protein, 40 aa, Artificial Sequence; identical to SEQ ID NO: 121
  Description of Artificial Sequence: Synthetic Peptide

SEQ ID NO: 123 - protein, 15 aa, Artificial Sequence
  Description of Artificial Sequence: Synthetic Peptide
EQGESNQERGARARL

SEQ ID NO: 124 - protein, 42 aa, Artificial Sequence
  Description of Artificial Sequence: Synthetic Peptide
HVDAIFTTNYRKLLSQLYARKVIQDIMNKQGERIQEQRARLS

SEQ ID NO: 125 - protein, 44 aa, Artificial Sequence
  Description of Artificial Sequence: Synthetic Peptide
YADAIFTNSYRKILGQLSARKLLQDIMNRQQGERNQEQGAKVRL

SEQ ID NO: 126 - protein, 43 aa, Artificial Sequence
  Description of Artificial Sequence: Synthetic Peptide
HADAIFTSSYRRILGQLYARKLLHEIMNRQQGERNQEQRSRFN

SEQ ID NO: 127 - protein, 6 aa, Artificial Sequence
  Description of Artificial Sequence: Synthetic Peptide
HWAWFK

SEQ ID NO: 128 - protein, 6 aa, Artificial Sequence
  Description of Artificial Sequence: Synthetic Peptide
HWAWFK

SEQ ID NO: 129 - protein, 5 aa, Artificial Sequence
  Description of Artificial Sequence: Synthetic Peptide
AAWFK

SEQ ID NO: 130 - protein, 6 aa, Artificial Sequence
  Description of Artificial Sequence: Synthetic Peptide
HWKWFK

SEQ ID NO: 131 - protein, 6 aa, Artificial Sequence
  Description of Artificial Sequence: Synthetic Peptide
AAAWFL

SEQ ID NO: 132 - protein, 45 aa, Artificial Sequence
  Description of Artificial Sequence: Synthetic Peptide
HADGMFNKAYRKALGQLSARKYLHTLMAKRVGGGSMIEDDNEPLS

SEQ ID NO: 133 - protein, 44 aa, Artificial Sequence
  Description of Artificial Sequence: Synthetic Peptide
YADAIFTNSYRKVLGQLSARKLLQDINSRQQGESNQERGARARL

SEQ ID NO: 134 - protein, 28 aa, Artificial Sequence
  Description of Artificial Sequence: Synthetic Peptide
YADAIFTNCYRKVLCQLSARKLLQDISR

SEQ ID NO: 135 - protein, 8 aa, Artificial Sequence
  Description of Artificial Sequence: Synthetic Peptide
FSKKLKPA

SEQ ID NO: 136 - protein, 10 aa, Artificial Sequence
  Description of Artificial Sequence: Synthetic Peptide
EHWSHGWYPG

SEQ ID NO: 137 - protein, 10 aa, Artificial Sequence
  Description of Artificial Sequence: Synthetic Peptide
EHWSYGLRPG

SEQ ID NO: 138 - protein, 7 aa, Artificial Sequence
  Description of Artificial Sequence: Synthetic Peptide
FSYLRPA

SEQ ID NO: 139 - protein, 10 aa, Artificial Sequence
  Description of Artificial Sequence: Synthetic Peptide
EHWSYALRPG

SEQ ID NO: 140 - protein, 10 aa, Artificial Sequence
  Description of Artificial Sequence: Synthetic Peptide
EHWSYGLQPG

SEQ ID NO: 141 - protein, 7 aa, Artificial Sequence
  Description of Artificial Sequence: Synthetic Peptide
HWSYVRP

SEQ ID NO: 142 - protein, 10 aa, Artificial Sequence
  Description of Artificial Sequence: Synthetic Peptide
EHWSYKLRPG

SEQ ID NO: 143 - protein, 10 aa, Artificial Sequence
  Description of Artificial Sequence: Synthetic Peptide
EFPSYFLRPG

SEQ ID NO: 144 - protein, 9 aa, Artificial Sequence
  Description of Artificial Sequence: Synthetic Peptide
FWSYALRPG

SEQ ID NO: 145 - protein, 10 aa, Artificial Sequence
  Description of Artificial Sequence: Synthetic Peptide
EFWSYWLRPG

SEQ ID NO: 146 - protein, 9 aa, Artificial Sequence
  Description of Artificial Sequence: Synthetic Peptide
EHWSYGLRP

SEQ ID NO: 147 - protein, 9 aa, Artificial Sequence
  Description of Artificial Sequence: Synthetic Peptide
EHWSYALRP

SEQ ID NO: 148 - protein, 9 aa, Artificial Sequence
  Description of Artificial Sequence: Synthetic Peptide
HWSYWLRPG

SEQ ID NO: 149 - protein, 9 aa, Artificial Sequence
  Description of Artificial Sequence: Synthetic Peptide
EHWSYWLRP

SEQ ID NO: 150 - protein, 8 aa, Artificial Sequence
  Description of Artificial Sequence: Synthetic Peptide
HWSYSLRP

SEQ ID NO: 151 - protein, 9 aa, Artificial Sequence
  Description of Artificial Sequence: Synthetic Peptide
EHWSYRWLP

SEQ ID NO: 152 - protein, 4 aa, Artificial Sequence
  Description of Artificial Sequence: Synthetic Peptide
LRPG

SEQ ID NO: 153 - protein, 9 aa, Artificial Sequence
  Description of Artificial Sequence: Synthetic Peptide
HWSYGLRPG

SEQ ID NO: 154 - protein, 10 aa, Artificial Sequence
  Description of Artificial Sequence: Synthetic Peptide
EHYSLEWKPG

SEQ ID NO: 155 - protein, 10 aa, Artificial Sequence
  Description of Artificial Sequence: Synthetic Peptide
EHWSYGWLPG

SEQ ID NO: 156 - protein, 7 aa, Artificial Sequence
  Description of Artificial Sequence: Synthetic Peptide
SYGLRPG

SEQ ID NO: 157 - protein, 9 aa, Artificial Sequence
  Description of Artificial Sequence: Synthetic Peptide
HWSYGLKPG

SEQ ID NO: 158 - protein, 7 aa, Artificial Sequence
  Description of Artificial Sequence: Synthetic Peptide
FFSYLRP

SEQ ID NO: 159 - protein, 9 aa, Artificial Sequence
  Description of Artificial Sequence: Synthetic Peptide
HWSYGWLPG

SEQ ID NO: 160 - protein, 9 aa, Artificial Sequence
  Description of Artificial Sequence: Synthetic Peptide
HWSYSLRPG

SEQ ID NO: 161 - protein, 9 aa, Artificial Sequence
  Description of Artificial Sequence: Synthetic Peptide
AFWSYSLRP

SEQ ID NO: 162 - protein, 31 aa, Artificial Sequence
  Description of Artificial Sequence: Synthetic Peptide
EPDCCRQKTCSCRLYELLHGAGNHAAGILTL

SEQ ID NO: 163 - protein, 28 aa, Artificial Sequence
  Description of Artificial Sequence: Synthetic Peptide
RSGPPGLQGRLQRLLQASGNHAAGILTM

SEQ ID NO: 164 - protein, 28 aa, Artificial Sequence
  Description of Artificial Sequence: Synthetic Peptide
RPGPPGLQGRLQRLLQANGNHAAGILTM

SEQ ID NO: 165 - protein, 31 aa, Artificial Sequence
  Description of Artificial Sequence: Synthetic Peptide
SRTHRHSMEIRTPDINPAWYASRGIRPVGRF

SEQ ID NO: 166 - protein, 20 aa, Artificial Sequence
  Description of Artificial Sequence: Synthetic Peptide
TPDINPAWYASRGIRPVGRF

SEQ ID NO: 167 - protein, 31 aa, Artificial Sequence
  Description of Artificial Sequence: Synthetic Peptide
SRAHQHSMETRTPDINPAWYTGRGIRPVGRF

SEQ ID NO: 168 - protein, 20 aa, Artificial Sequence
  Description of Artificial Sequence: Synthetic Peptide
TPDINPAWYTGRGIRPVGRF

SEQ ID NO: 169 - protein, 31 aa, Artificial Sequence
  Description of Artificial Sequence: Synthetic Peptide
SRAHQHSMEIRTPDINPAWYASRGIRPVGRF

SEQ ID NO: 170 - protein, 20 aa, Artificial Sequence
  Description of Artificial Sequence: Synthetic Peptide
TPDINPAWYAGRGIRPVGRF

SEQ ID NO: 171 - protein, 5 aa, Artificial Sequence
  Description of Artificial Sequence: Synthetic Peptide
AYWKF

SEQ ID NO: 172 - protein, 14 aa, Artificial Sequence
  Description of Artificial Sequence: Synthetic Peptide
PCKNFFWKTFSSCK

SEQ ID NO: 173 - protein, 17 aa, Artificial Sequence
  Description of Artificial Sequence: Synthetic Peptide
DRMPCRNFFWKTFSSCK

SEQ ID NO: 174 - protein, 17 aa, Artificial Sequence
  Description of Artificial Sequence: Synthetic Peptide
DRMPCRNFFWKTFSSCK

SEQ ID NO: 175 - protein, 14 aa, Artificial Sequence
  Description of Artificial Sequence: Synthetic Peptide
AGCKNFFWKTFTSC

SEQ ID NO: 176 - protein, 13 aa, Artificial Sequence
  Description of Artificial Sequence: Synthetic Peptide
AGCKNFFKTFTSC

SEQ ID NO: 177 - protein, 13 aa, Artificial Sequence
  Description of Artificial Sequence: Synthetic Peptide
AGCKNFFKTYTSC

SEQ ID NO: 178 - protein, 11 aa, Artificial Sequence
  Description of Artificial Sequence: Synthetic Peptide
CHHFFKTFTSC

SEQ ID NO: 179 - protein, 14 aa, Artificial Sequence
  Description of Artificial Sequence: Synthetic Peptide
AGCKNFFWKTWTSC

SEQ ID NO: 180 - protein, 5 aa, Artificial Sequence
  Description of Artificial Sequence: Synthetic Peptide
FCYTT

SEQ ID NO: 181 - protein, 27 aa, Artificial Sequence
  Description of Artificial Sequence: Synthetic Peptide
SANSNPAAPRERKAGCKNFFWKTFTSC

SEQ ID NO: 182 - protein, 7 aa, Artificial Sequence
  Description of Artificial Sequence: Synthetic Peptide
FCFKTCT

SEQ ID NO: 183 - protein, 32 aa, Artificial Sequence
  Description of Artificial Sequence: Synthetic Peptide
APSDPRLRQFLQKSLAAAAGKQELAKYFLAEL

SEQ ID NO: 184 - protein, 15 aa, Artificial Sequence
  Description of Artificial Sequence: Synthetic Peptide
YAGCKNFFWKTFTSC

SEQ ID NO: 185 - protein, 14 aa, Artificial Sequence
  Description of Artificial Sequence: Synthetic Peptide
YGCKNFFWKTFTSC

SEQ ID NO: 186 - protein, 14 aa, Artificial Sequence
  Description of Artificial Sequence: Synthetic Peptide
SANSNPAMAPRYRK

SEQ ID NO: 187 - protein, 14 aa, Artificial Sequence
  Description of Artificial Sequence: Synthetic Peptide
AGCKNFFWKTYTSC

SEQ ID NO: 188 - protein, 15 aa, Artificial Sequence
  Description of Artificial Sequence: Synthetic Peptide
YAGCKNFFWKTFTSC

SEQ ID NO: 189 - protein, 14 aa, Artificial Sequence
  Description of Artificial Sequence: Synthetic Peptide
AGCKNFFWKTFTSC

SEQ ID NO: 190 - protein, 4 aa, Artificial Sequence
  Description of Artificial Sequence: Synthetic Peptide
FWKT

SEQ ID NO: 191 - protein, 25 aa, Artificial Sequence
  Description of Artificial Sequence: Synthetic Peptide
SNPAMAPRERKAGCKNFFWKTFTSC

SEQ ID NO: 192 - protein, 28 aa, Artificial Sequence
  Description of Artificial Sequence: Synthetic Peptide
SANSNPAMAPRERKAGCKNFFWKTFTSC

SEQ ID NO: 193 - protein, 12 aa, Artificial Sequence
  Description of Artificial Sequence: Synthetic Peptide
SANSNPAMAPRE

SEQ ID NO: 194 - protein, 29 aa, Artificial Sequence
  Description of Artificial Sequence: Synthetic Peptide
YSANSNPAMAPRERKAGCKNFFWKTFTSC

SEQ ID NO: 195 - protein, 28 aa, Artificial Sequence
  Description of Artificial Sequence: Synthetic Peptide
SANSNPALAPRERKAGCKNFFWKTYTSC

SEQ ID NO: 196 - protein, 14 aa, Artificial Sequence
  Description of Artificial Sequence: Synthetic Peptide
SANSNPAMAPRERK

SEQ ID NO: 197 - protein, 8 aa, Artificial Sequence
  Description of Artificial Sequence: Synthetic Peptide
FCYWKVCW

SEQ ID NO: 198 - protein, 8 aa, Artificial Sequence
  Description of Artificial Sequence: Synthetic Peptide
FCYWKVCW

SEQ ID NO: 199 - protein, 6 aa, Artificial Sequence
  Description of Artificial Sequence: Synthetic Peptide
FCYWTT

SEQ ID NO: 200 - protein, 8 aa, Artificial Sequence
  Description of Artificial Sequence: Synthetic Peptide
ACYWLVCT

SEQ ID NO: 201 - protein, 14 aa, Artificial Sequence
  Description of Artificial Sequence: Synthetic Peptide
AGCKNFFWKTFTSC

SEQ ID NO: 202 - protein, 3 aa, Artificial Sequence
  Description of Artificial Sequence: Synthetic Peptide
HPG

SEQ ID NO: 203 - protein, 1 aa, Artificial Sequence
  Description of Artificial Sequence: Synthetic Peptide
T

SEQ ID NO: 204 - protein, 3 aa, Artificial Sequence
  Description of Artificial Sequence: Synthetic Peptide
THP

SEQ ID NO: 205 - protein, 3 aa, Artificial Sequence
  Description of Artificial Sequence: Synthetic Peptide
EHP

SEQ ID NO: 206 - protein, 3 aa, Artificial Sequence
  Description of Artificial Sequence: Synthetic Peptide
EQP

SEQ ID NO: 207 - protein, 2 aa, Artificial Sequence
  Description of Artificial Sequence: Synthetic Peptide
EH

SEQ ID NO: 208 - protein, 4 aa, Artificial Sequence
  Description of Artificial Sequence: Synthetic Peptide
HPGK

SEQ ID NO: 209 - protein, 3 aa, Artificial Sequence
  Description of Artificial Sequence: Synthetic Peptide
HPG

SEQ ID NO: 210 - protein, 2 aa, Artificial Sequence
  Description of Artificial Sequence: Synthetic Peptide
EP

SEQ ID NO: 211 - protein, 2 aa, Artificial Sequence
  Description of Artificial Sequence: Synthetic Peptide
FP

SEQ ID NO: 212 - protein, 22 aa, Artificial Sequence
  Description of Artificial Sequence: Synthetic Peptide
FLWKDLQRVRGDLGAALDSWIT

SEQ ID NO: 213 - protein, 24 aa, Artificial Sequence
  Description of Artificial Sequence: Synthetic Peptide
EEEEKDIEAEERGDLGEGGAWRLH

SEQ ID NO: 214 - protein, 10 aa, Artificial Sequence
  Description of Artificial Sequence: Synthetic Peptide
SFPWMESDVT

SEQ ID NO: 215 - protein, 32 aa, Artificial Sequence
  Description of Artificial Sequence: Synthetic Peptide
CASLSTCVLGKLSQELHKLQTYPRTDVGAGTP

SEQ ID NO: 216 - protein, 32 aa, Artificial Sequence
  Description of Artificial Sequence: Synthetic Peptide
CSNLSTCVLGKLSQELHKLQTYPRTDVGAGTP

SEQ ID NO: 217 - protein, 32 aa, Artificial Sequence
  Description of Artificial Sequence: Synthetic Peptide
CGNLSTCMLGTYTQDFNKFHTFPQTAIGVGAP

SEQ ID NO: 218 - protein, 32 aa, Artificial Sequence
  Description of Artificial Sequence: Synthetic Peptide
CSNLSTCVLSAYWRNLNNFHRFSGMGFGPETP

SEQ ID NO: 219 - protein, 32 aa, Artificial Sequence
  Description of Artificial Sequence: Synthetic Peptide
CGNLSTCMLGTYTQDLNKFHTFPQTSIGVGAP

SEQ ID NO: 220 - protein, 32 aa, Artificial Sequence
  Description of Artificial Sequence: Synthetic Peptide
CSNLSTCVLGKLSQELHKLQTYPRTNTGSGTP

SEQ ID NO: 221 - protein, 25 aa, Artificial Sequence
  Description of Artificial Sequence: Synthetic Peptide
VLGKLSQELHKLQTYPRTNTGSGTP

SEQ ID NO: 222 - protein, 21 aa, Artificial Sequence
  Description of Artificial Sequence: Synthetic Peptide
DMSSDLERDHRPHVSMPQNAN

SEQ ID NO: 223 - protein, 57 aa, Artificial Sequence
  Description of Artificial Sequence: Synthetic Peptide
APFRSALESSPADPATLSEDEARLLLAALVQDYVQMKASELEQEQEREGSSLDSPRS

SEQ ID NO: 224 - protein, 37 aa, Artificial Sequence
  Description of Artificial Sequence: Synthetic Peptide
SCNTATCVTHRLAGLLSRSGGVVKSNFVPTNVGSQAF

SEQ ID NO: 225 - protein, 19 aa, Artificial Sequence
  Description of Artificial Sequence: Synthetic Peptide
SGGVVKNNFVPTNVGSKAF

SEQ ID NO: 226 - protein, 19 aa, Artificial Sequence
  Description of Artificial Sequence: Synthetic Peptide
SGGVVKNNFVPTNVGSKAF

SEQ ID NO: 227 - protein, 15 aa, Artificial Sequence
  Description of Artificial Sequence: Synthetic Peptide
VKNNFVPTNVGSKAF

SEQ ID NO: 228 - protein, 37 aa, Artificial Sequence
  Description of Artificial Sequence: Synthetic Peptide
SCNTATCVTHRLAGLLSRSGGVVKDNFVPTNVGSKAF

SEQ ID NO: 229 - protein, 37 aa, Artificial Sequence
  Description of Artificial Sequence: Synthetic Peptide
ACNTATCVTHRLADFLSRSGGVGKNNFVPTNVGSKAF

SEQ ID NO: 230 - protein, 37 aa, Artificial Sequence
  Description of Artificial Sequence: Synthetic Peptide
ACDTATCVTHRLAGLLSRSGGVVKNNFVPTNVGSKAF

SEQ ID NO: 231 - protein, 7 aa, Artificial Sequence
  Description of Artificial Sequence: Synthetic Peptide
CGNLSTC

SEQ ID NO: 232 - protein, 16 aa, Artificial Sequence
  Description of Artificial Sequence: Synthetic Peptide
DMAKDLETNHHPYFGN

SEQ ID NO: 233 - protein, 19 aa, Artificial Sequence
  Description of Artificial Sequence: Synthetic Peptide
ACDTATCVTHRLAGLLSRS

SEQ ID NO: 234 - protein, 18 aa, Artificial Sequence
  Description of Artificial Sequence: Synthetic Peptide
GGVVKNNFVPTNVGSKAF

SEQ ID NO: 235 - protein, 30 aa, Artificial Sequence
  Description of Artificial Sequence: Synthetic Peptide
VTHRLAGLLSRSGGVVKNNFVPTNVGSKAF

SEQ ID NO: 236 - protein, 37 aa, Artificial Sequence
  Description of Artificial Sequence: Synthetic Peptide
ACNTATCVTHRLAGLLSRSGGMVKSNFVPTNVGSKAF

SEQ ID NO: 237 - protein, 37 aa, Artificial Sequence
  Description of Artificial Sequence: Synthetic Peptide
SCNTATCVTHRLAGLLSRSGGVVKDNFVPTNVGSEAF

SEQ ID NO: 238 - protein, 37 aa, Artificial Sequence; identical to SEQ ID NO: 237
  Description of Artificial Sequence: Synthetic Peptide

SEQ ID NO: 239 - protein, 30 aa, Artificial Sequence
  Description of Artificial Sequence: Synthetic Peptide
VTHRLAGLLSRSGGVVKDNFVPTNVGSEAF

SEQ ID NO: 240 - protein, 9 aa, Artificial Sequence
  Description of Artificial Sequence: Synthetic Peptide
PTNVGSEAF

SEQ ID NO: 241 - protein, 8 aa, Artificial Sequence
  Description of Artificial Sequence: Synthetic Peptide
TNVGSEAF

SEQ ID NO: 242 - protein, 7 aa, Artificial Sequence
  Description of Artificial Sequence: Synthetic Peptide
NVGSEAF

SEQ ID NO: 243 - protein, 6 aa, Artificial Sequence
  Description of Artificial Sequence: Synthetic Peptide
VGSEAF

SEQ ID NO: 244 - protein, 6 aa, Artificial Sequence
  Description of Artificial Sequence: Synthetic Peptide
VGSEAF

SEQ ID NO: 245 - protein, 4 aa, Artificial Sequence
  Description of Artificial Sequence: Synthetic Peptide
SEAF

SEQ ID NO: 246 - protein, 37 aa, Artificial Sequence; identical to SEQ ID NO: 230
  Description of Artificial Sequence: Synthetic Peptide

SEQ ID NO: 247 - protein, 30 aa, Artificial Sequence
  Description of Artificial Sequence: Synthetic Peptide
SNLSTVLGKLSQELHKLQTYPRTDVGAGTP

SEQ ID NO: 248 - protein, 38 aa, Artificial Sequence
  Description of Artificial Sequence: Synthetic Peptide
YACDTATCVTHRLAGLLSRSGGVVKNNFVPTNVGSKAF

SEQ ID NO: 249 - protein, 38 aa, Artificial Sequence
  Description of Artificial Sequence: Synthetic Peptide
YACNTATCVTHRLAGLLSRSGGMVKSNFVPTNVGSKAF

SEQ ID NO: 250 - protein, 11 aa, Artificial Sequence
  Description of Artificial Sequence: Synthetic Peptide
YVPTNVGSEAF

SEQ ID NO: 251 - protein, 38 aa, Artificial Sequence
  Description of Artificial Sequence: Synthetic Peptide
YSCNTATCVTHRLAGLLSRSGGVVKDNFVPTNVGSEAF

SEQ ID NO: 252 - protein, 16 aa, Artificial Sequence
  Description of Artificial Sequence: Synthetic Peptide
YVKDNFVPTNVGSEAF

SEQ ID NO: 253 - protein, 37 aa, Artificial Sequence; identical to SEQ ID NO: 237
  Description of Artificial Sequence: Synthetic Peptide

SEQ ID NO: 254 - protein, 46 aa, Artificial Sequence
  Description of Artificial Sequence: Synthetic Peptide
APLAPRDAGSQRPRKKEDNVLVESHEKSLGEADKADVNVLTKAKSQ

SEQ ID NO: 255 - protein, 32 aa, Artificial Sequence
  Description of Artificial Sequence: Synthetic Peptide
KKEDNVLVESHEKSLGEADKADVDVLTKAKSQ

SEQ ID NO: 256 - protein, 84 aa, Artificial Sequence
  Description of Artificial Sequence: Synthetic Peptide
SVSEIQLMHNLGKHLNSMERVEWLRKKLQDVHNFVALGAPLAPRDAGSQRPRKKEDNVLVESHEKSLGEADKADVNVLTKAKSQ

SEQ ID NO: 257 - protein, 21 aa, Artificial Sequence
  Description of Artificial Sequence: Synthetic Peptide
EKSLGEADKADVNVLTKAKSQ

SEQ ID NO: 258 - protein, 34 aa, Artificial Sequence
  Description of Artificial Sequence: Synthetic Peptide
SVSEIQLNHNLGKHLNSLERVEWLRKKLQDVHNF

SEQ ID NO: 259 - protein, 34 aa, Artificial Sequence
  Description of Artificial Sequence: Synthetic Peptide
SVSECQLMHNLGKHLNSMERVEWLRKKCQDVHNF

SEQ ID NO: 260 - protein, 40 aa, Artificial Sequence
  Description of Artificial Sequence: Synthetic Peptide
AVSEHQLLHDKGKSIQDLRRRFFLHHLIAEIHTAEIRATS

SEQ ID NO: 261 - protein, 34 aa, Artificial Sequence
  Description of Artificial Sequence: Synthetic Peptide
SVSEIQLMHNLGKHLNSLERVEWLRKKLQDVHNF

SEQ ID NO: 262 - protein, 32 aa, Artificial Sequence
  Description of Artificial Sequence: Synthetic Peptide
AVSEIQFHNLGKHLSSERVEWLRKKLQDVHNY

SEQ ID NO: 263 - protein, 30 aa, Artificial Sequence
  Description of Artificial Sequence: Synthetic Peptide
SEIQFHNLGKHLSSERVEWLRKKLQDVHNY

SEQ ID NO: 264 - protein, 32 aa, Artificial Sequence
  Description of Artificial Sequence: Synthetic Peptide
SVSEIQLHNLGKHLNSERVEWLRKKLQDVHNY

SEQ ID NO: 265 - protein, 32 aa, Artificial Sequence; identical to SEQ ID NO: 264
  Description of Artificial Sequence: Synthetic Peptide

SEQ ID NO: 266 - protein, 30 aa, Artificial Sequence
  Description of Artificial Sequence: Synthetic Peptide
SEIQLHNLGKHLNSERVEWLRKKLQDVHNY

SEQ ID NO: 267 - protein, 26 aa, Artificial Sequence
  Description of Artificial Sequence: Synthetic Peptide
FHNLGKHLSSERVEWLRKKLQDVHNY

SEQ ID NO: 268 - protein, 32 aa, Artificial Sequence
  Description of Artificial Sequence: Synthetic Peptide
AVSEIQLHNLGKHLASVERQWLRKKLQDVHNY

SEQ ID NO: 269 - protein, 25 aa, Artificial Sequence
  Description of Artificial Sequence: Synthetic Peptide
RDAGSQRPRKKEDNVLVESHEKSLG

SEQ ID NO: 270 - protein, 32 aa, Artificial Sequence
  Description of Artificial Sequence: Synthetic Peptide
SEIQFMHNLGKHLSSMERVEWLRKKLQDVHNF

SEQ ID NO: 271 - protein, 31 aa, Artificial Sequence
  Description of Artificial Sequence: Synthetic Peptide
SVSEIQLMHNLGKHLNSMERVEWLRKKLQDV

SEQ ID NO: 272 - protein, 34 aa, Artificial Sequence
  Description of Artificial Sequence: Synthetic Peptide
SVSEIQLMHNLGKHLNSMERVEWLRKKLQDVHNF

SEQ ID NO: 273 - protein, 22 aa, Artificial Sequence
  Description of Artificial Sequence: Synthetic Peptide
KHLNSMERVEWLRKKLQDVHNF

SEQ ID NO: 274 - protein, 34 aa, Artificial Sequence
  Description of Artificial Sequence: Synthetic Peptide
AVSEIQLMHNLGKHLASVERMQWLRKKLQDVHNF

SEQ ID NO: 275 - protein, 38 aa, Artificial Sequence
  Description of Artificial Sequence: Synthetic Peptide
SVSEIQLMHNLGKHLNSMERVEWLRKKLQDVHNFVALG

SEQ ID NO: 276 - protein, 44 aa, Artificial Sequence
  Description of Artificial Sequence: Synthetic Peptide
SVSEIQLMHNLGKHLNSMERVEWLRKKLQDVHNFVALGAPLAPR

SEQ ID NO: 277 - protein, 21 aa, Artificial Sequence
  Description of Artificial Sequence: Synthetic Peptide
LQDVHNFVALGAPLAPRDAGS

SEQ ID NO: 278 - protein, 30 aa, Artificial Sequence
  Description of Artificial Sequence: Synthetic Peptide
APLAPRDAGSQRPRKKEDNVLVESHEKSLG

SEQ ID NO: 279 - protein, 46 aa, Artificial Sequence; identical to SEQ ID NO: 254
  Description of Artificial Sequence: Synthetic Peptide

SEQ ID NO: 280 - protein, 32 aa, Artificial Sequence; identical to SEQ ID NO: 255
  Description of Artificial Sequence: Synthetic Peptide

SEQ ID NO: 281 - protein, 16 aa, Artificial Sequence
  Description of Artificial Sequence: Synthetic Peptide
EADKADVNVLTKAKSQ

SEQ ID NO: 282 - protein, 15 aa, Artificial Sequence
  Description of Artificial Sequence: Synthetic Peptide
ADKADVNVLTKAKSQ

SEQ ID NO: 283 - protein, 36 aa, Artificial Sequence
  Description of Artificial Sequence: Synthetic Peptide
YPIKPEAPGEDASPEELNRYYASLRHYLNLVTRPRY

SEQ ID NO: 284 - protein, 41 aa, Artificial Sequence
  Description of Artificial Sequence: Synthetic Peptide
YAVSEHQLLHDKGKSIQDLRRRFFLHHLIAEIHTAEIRATS

SEQ ID NO: 285 - protein, 45 aa, Artificial Sequence
  Description of Artificial Sequence: Synthetic Peptide
YSVSEIQLMHNLGKHLNSMERVEWLRKKLQDVHNFVALGAPLAPR

SEQ ID NO: 286 - protein, 35 aa, Artificial Sequence
  Description of Artificial Sequence: Synthetic Peptide
YSVSEIQLMHNLGKHLNSMERVEWLRKKLQDVHNF

SEQ ID NO: 287 - protein, 34 aa, Artificial Sequence
  Description of Artificial Sequence: Synthetic Peptide
YVSEIQLMHNLGKHLNSMERVEWLRKKLQDVHNF

SEQ ID NO: 288 - protein, 22 aa, Artificial Sequence
  Description of Artificial Sequence: Synthetic Peptide
YLQDVHNFVALGAPLAPRDAGS

SEQ ID NO: 289 - protein, 28 aa, Artificial Sequence
  Description of Artificial Sequence: Synthetic Peptide
FMHNLGKHLSSMERVEWLRKKLQDVHNY

SEQ ID NO: 290 - protein, 26 aa, Artificial Sequence
  Description of Artificial Sequence: Synthetic Peptide
YRDAGSQRPRKKEDNVLVESHEKSLG

SEQ ID NO: 291 - protein, 33 aa, Artificial Sequence
  Description of Artificial Sequence: Synthetic Peptide
YKKEDNVLVESHEKSLGEADKADVNVLTKAKSQ

SEQ ID NO: 292 - protein, 22 aa, Artificial Sequence
  Description of Artificial Sequence: Synthetic Peptide
YEKSLGEADKADVNVLTKAKSQ

SEQ ID NO: 293 - protein, 34 aa, Artificial Sequence
  Description of Artificial Sequence: Synthetic Peptide
AVSEHQLLHDKGKSIQDLRRRFFLHHLIAEIHTA

SEQ ID NO: 294 - protein, 5 aa, Artificial Sequence
  Description of Artificial Sequence: Synthetic Peptide
ARSAW

SEQ ID NO: 295 - protein, 34 aa, Artificial Sequence; identical to SEQ ID NO: 293
  Description of Artificial Sequence: Synthetic Peptide

SEQ ID NO: 296 - protein, 33 aa, Artificial Sequence
  Description of Artificial Sequence: Synthetic Peptide
VSEHQLLHDKGKSIQDLRRRFFLHHLIAEIHTA

SEQ ID NO: 297 - protein, 35 aa, Artificial Sequence
  Description of Artificial Sequence: Synthetic Peptide
YAVSEHQLLHDKGKSIQDLRRRFFLHHLIAEIHTA

SEQ ID NO: 298 - protein, 34 aa, Artificial Sequence
  Description of Artificial Sequence: Synthetic Peptide
AVSEHQLLHDKGKSIQDLRRRFFLHHLIAEIHTY

SEQ ID NO: 299 - protein, 37 aa, Artificial Sequence
  Description of Artificial Sequence: Synthetic Peptide
AVSEHQLLHDKGKSIQDLRRRFFLHHLIAEIHTAEIR

SEQ ID NO: 300 - protein, 28 aa, Artificial Sequence
  Description of Artificial Sequence: Synthetic Peptide
LLHDKGKSIQDLRRRFFLHHLIAEIHTA

SEQ ID NO: 301 - protein, 27 aa, Artificial Sequence
  Description of Artificial Sequence: Synthetic Peptide
ATSEVSPNSKPSPNTKNHPVRFGSDDE

SEQ ID NO: 302 - protein, 20 aa, Artificial Sequence
  Description of Artificial Sequence: Synthetic Peptide
YLTQETNKVETYKEQPLKTP

SEQ ID NO: 303 - protein, 5 aa, Artificial Sequence
  Description of Artificial Sequence: Synthetic Peptide
TRSAW

SEQ ID NO: 304 - protein, 5 aa, Artificial Sequence
  Description of Artificial Sequence: Synthetic Peptide
TRSAW

SEQ ID NO: 305 - protein, 32 aa, Artificial Sequence
  Description of Artificial Sequence: Synthetic Peptide
TRSAWLDSGVTGSGLEGDHLSDTSTTSLELDS

SEQ ID NO: 306 - protein, 33 aa, Artificial Sequence
  Description of Artificial Sequence: Synthetic Peptide
SAWLDSGVTGSGLEGDHLSDTSTTSLELDSRRH

SEQ ID NO: 307 - protein, 34 aa, Artificial Sequence
  Description of Artificial Sequence: Synthetic Peptide
TALLWGLKKKKENNRRTHHMQLMISLFKSPLLLL

SEQ ID NO: 308 - protein, 31 aa, Artificial Sequence [sequence omitted]

SEQ ID NO: 309 - protein, 27 aa, Artificial Sequence
  Description of Artificial Sequence: Synthetic Peptide
TALLWGLKKKKGKQQKNTSYATNDLII

SEQ ID NO: 310 - protein, 30 aa, Artificial Sequence
  Description of Artificial Sequence: Synthetic Peptide
ATQRLANFLVHSSNNFGAILSSTNVGSNTY

SEQ ID NO: 311 - protein, 30 aa, Artificial Sequence
  Description of Artificial Sequence: Synthetic Peptide
ATQRLANFLVRSSNNLGPVLPPTNVGSNTY

SEQ ID NO: 312 - protein, 25 aa, Artificial Sequence
  Description of Artificial Sequence: Synthetic Peptide
VLGKLSQELHKLQTYPRTNTGSNTY

SEQ ID NO: 313 - protein, 24 aa, Artificial Sequence
  Description of Artificial Sequence: Synthetic Peptide
LGRLSQELHRLQTYPRTNTGSNTY

SEQ ID NO: 314 - protein, 25 aa, Artificial Sequence
  Description of Artificial Sequence: Synthetic Peptide
ATQRLANELVRLQTYPRTNVGSNTY

SEQ ID NO: 315 - protein, 29 aa, Artificial Sequence
  Description of Artificial Sequence: Synthetic Peptide
TQRLANFLVHSSNNFGAILSSTNVGSNTY

SEQ ID NO: 316 - protein, 37 aa, Artificial Sequence
  Description of Artificial Sequence: Synthetic Peptide
KCNTATCATQRLANFLIRSSNNLGAILSPTNVGSNTY

SEQ ID NO: 317 - protein, 37 aa, Artificial Sequence [sequence omitted]

SEQ ID NO: 318 - protein, 37 aa, Artificial Sequence [sequence omitted]

SEQ ID NO: 319 - protein, 13 aa, Artificial Sequence
  Description of Artificial Sequence: Synthetic Peptide
KCNTATCATQRLA

SEQ ID NO: 320 - protein, 10 aa, Artificial Sequence
  Description of Artificial Sequence: Synthetic Peptide
SNNFGAILSS

SEQ ID NO: 321 - protein, 37 aa, Artificial Sequence
  Description of Artificial Sequence: Synthetic Peptide
KCNTATCATQRLANFLVRSSNNLGPVLPPTNVGSNTY

SEQ ID NO: 322 - protein, 30 aa, Artificial Sequence; identical to SEQ ID NO: 311
  Description of Artificial Sequence: Synthetic Peptide

SEQ ID NO: 323 - protein, 30 aa, Artificial Sequence; identical to SEQ ID NO: 310
  Description of Artificial Sequence: Synthetic Peptide

SEQ ID NO: 324 - protein, 30 aa, Artificial Sequence; identical to SEQ ID NO: 311
  Description of Artificial Sequence: Synthetic Peptide

SEQ ID NO: 325 - protein, 25 aa, Artificial Sequence
  Description of Artificial Sequence: Synthetic Peptide
VLGKLSQELHKLQTYPRTNTGSNTY

SEQ ID NO: 326 - protein, 24 aa, Artificial Sequence
  Description of Artificial Sequence: Synthetic Peptide
LGRLSQELHRLQTYPRTNTGSNTY

SEQ ID NO: 327 - protein, 25 aa, Artificial Sequence
  Description of Artificial Sequence: Synthetic Peptide
ATQRLANELVRLQTYPRTNVGSNTY

SEQ ID NO: 328 - protein, 29 aa, Artificial Sequence
  Description of Artificial Sequence: Synthetic Peptide
TQRLANFLVHSSNNFGAILSSTNVGSNTY

SEQ ID NO: 329 - protein, 37 aa, Artificial Sequence; identical to SEQ ID NO: 316
  Description of Artificial Sequence: Synthetic Peptide

SEQ ID NO: 330 - protein, 37 aa, Artificial Sequence [sequence omitted]

SEQ ID NO: 331 - protein, 37 aa, Artificial Sequence [sequence omitted]

SEQ ID NO: 332 - protein, 13 aa, Artificial Sequence
  Description of Artificial Sequence: Synthetic Peptide
KCNTATCATQRLA

SEQ ID NO: 333 - protein, 10 aa, Artificial Sequence
  Description of Artificial Sequence: Synthetic Peptide
SNNFGAILSS

SEQ ID NO: 334 - protein, 37 aa, Artificial Sequence; identical to SEQ ID NO: 321
  Description of Artificial Sequence: Synthetic Peptide

SEQ ID NO: 335 - protein, 30 aa, Artificial Sequence; identical to SEQ ID NO: 311
  Description of Artificial Sequence: Synthetic Peptide

SEQ ID NO: 336 - protein, 28 aa, Artificial Sequence
  Description of Artificial Sequence: Synthetic Peptide
SQGTFTSEYSKYLDSRRAQDFVQWLMNT

SEQ ID NO: 337 - protein, 35 aa, Artificial Sequence
  Description of Artificial Sequence: Synthetic Peptide
HGEGTSDLSKQMEEARLFIEWLKNGGPSSGAPPPS

SEQ ID NO: 338 - protein, 29 aa, Artificial Sequence
  Description of Artificial Sequence: Synthetic Peptide
HSQGTFTSDYSKYLDSRRAQDFVQWLMNT

SEQ ID NO: 339 - protein, 11 aa, Artificial Sequence
  Description of Artificial Sequence: Synthetic Peptide
AQDFVQWLMNT

SEQ ID NO: 340 - protein, 8 aa, Artificial Sequence
  Description of Artificial Sequence: Synthetic Peptide
FVQWLMNT

SEQ ID NO: 341 - protein, 28 aa, Artificial Sequence
  Description of Artificial Sequence: Synthetic Peptide
SQGTFTSEYSKYLDSRRAQDFVQWLMNT

SEQ ID NO: 342 - protein, 36 aa, Artificial Sequence
  Description of Artificial Sequence: Synthetic Peptide
HDEFERHAEGTFTSDVSSYLEGQAAKEFIAWLVKGR

SEQ ID NO: 343 - protein, 37 aa, Artificial Sequence
  Description of Artificial Sequence: Synthetic Peptide
HDEFERHAEGTFTSDVSSYLEGQAAKEFIAWLVKGRG

SEQ ID NO: 344 - protein, 30 aa, Artificial Sequence
  Description of Artificial Sequence: Synthetic Peptide
HAEGTFTSDVSSYLEGQAAKEFIAWLVKGR

SEQ ID NO: 345 - protein, 33 aa, Artificial Sequence
  Description of Artificial Sequence: Synthetic Peptide
HADGSFSDEMNTILDNLATRDFINWLIQTKITD

SEQ ID NO: 346 - protein, 34 aa, Artificial Sequence
  Description of Artificial Sequence: Synthetic Peptide
HADGSFSDEMNTILDNLAARDFINWLIQTKITDR

SEQ ID NO: 347 - protein, 37 aa, Artificial Sequence
  Description of Artificial Sequence: Synthetic Peptide
HSEGTFTSDYSKYLDSRRAEDFVEWLMNTKRNKNNIA

SEQ ID NO: 348 - protein, 37 aa, Artificial Sequence; identical to SEQ ID NO: 347
  Description of Artificial Sequence: Synthetic Peptide

SEQ ID NO: 349 - protein, 39 aa, Artificial Sequence
  Description of Artificial Sequence: Synthetic Peptide
HGEGTFTSDLSKQMEEEAVRLFIEWLKNGGPSSGAPPPS

SEQ ID NO: 350 - protein, 34 aa, Artificial Sequence
  Description of Artificial Sequence: Synthetic Peptide
HADGTLTSDISSFLEKQATKEFIAWLVSGRGRRQ

SEQ ID NO: 351 - protein, 29 aa, Artificial Sequence
  Description of Artificial Sequence: Synthetic Peptide
HSQGTFTSDYSKYLDSKKAQEFVQWLMNT

SEQ ID NO: 352 - protein, 39 aa, Artificial Sequence; identical to SEQ ID NO: 349
  Description of Artificial Sequence: Synthetic Peptide

SEQ ID NO: 353 - protein, 33 aa, Artificial Sequence
  Description of Artificial Sequence: Synthetic Peptide
HADGSFTSDINKVLDTIAAKEFLNWLISTKVTE

SEQ ID NO: 354 - protein, 36 aa, Artificial Sequence; identical to SEQ ID NO: 342
  Description of Artificial Sequence: Synthetic Peptide

SEQ ID NO: 355 - protein, 30 aa, Artificial Sequence; identical to SEQ ID NO: 344
  Description of Artificial Sequence: Synthetic Peptide

SEQ ID NO: 356 - protein, 19 aa, Artificial Sequence
  Description of Artificial Sequence: Synthetic Peptide
  VARIANT (1)...(19): Xaa = Any Amino Acid
SYLEGQAAKEFIAWLVXGR

SEQ ID NO: 357 - protein, 4 aa, Artificial Sequence
  Description of Artificial Sequence: Synthetic Peptide
SDVS

SEQ ID NO: 358 - protein, 5 aa, Artificial Sequence
  Description of Artificial Sequence: Synthetic Peptide
TSDVS

SEQ ID NO: 359 - protein, 6 aa, Artificial Sequence
  Description of Artificial Sequence: Synthetic Peptide
FTSDVS

SEQ ID NO: 360 - protein, 7 aa, Artificial Sequence
  Description of Artificial Sequence: Synthetic Peptide
TFTSDVS

SEQ ID NO: 361 - protein, 8 aa, Artificial Sequence
  Description of Artificial Sequence: Synthetic Peptide
GTFTSDVS

SEQ ID NO: 362 - protein, 9 aa, Artificial Sequence
  Description of Artificial Sequence: Synthetic Peptide
EGTFTSDVS

SEQ ID NO: 363 - protein, 10 aa, Artificial Sequence
  Description of Artificial Sequence: Synthetic Peptide
AEGTFTSDVS

SEQ ID NO: 364 - protein, 39 aa, Artificial Sequence
  Description of Artificial Sequence: Synthetic Peptide
HSDGTFTSDLSKQMEEEAVRLFIEWLKNGGPSSGAPPPS

SEQ ID NO: 365 - protein, 39 aa, Artificial Sequence; identical to SEQ ID NO: 349
  Description of Artificial Sequence: Synthetic Peptide

SEQ ID NO: 366 - protein, 31 aa, Artificial Sequence
  Description of Artificial Sequence: Synthetic Peptide
HGEGTFTSDLSKQMEEAVRLFIEWLKNGGPY

SEQ ID NO: 367 - protein, 31 aa, Artificial Sequence
  Description of Artificial Sequence: Synthetic Peptide
HGEGTFTSDLSKQMEEEAVRLFIEWLKNGGY

SEQ ID NO: 368 - protein, 31 aa, Artificial Sequence
  Description of Artificial Sequence: Synthetic Peptide
DLSKQMEEEAVRLMIEWLKNGGPSSGAPPPS

SEQ ID NO: 369 - protein, 37 aa, Artificial Sequence
  Description of Artificial Sequence: Synthetic Peptide
HDEFERHAEGTFTSDVSSYLEGQAAKEFIAWLVKGRK

SEQ ID NO: 370 - protein, 31 aa, Artificial Sequence
  Description of Artificial Sequence: Synthetic Peptide
HAEGTFTSDVSSYLEGQAAKEFIAWLVKGRK

SEQ ID NO: 371 - protein, 40 aa, Artificial Sequence
  Description of Artificial Sequence: Synthetic Peptide
HGEGTFTSDLSKQMEEEAVRLFIEWLKNGGPSSGAPPPSK

SEQ ID NO: 372 - protein, 40 aa, Artificial Sequence; identical to SEQ ID NO: 371
  Description of Artificial Sequence: Synthetic Peptide

SEQ ID NO: 373 - protein, 40 aa, Artificial Sequence
  Description of Artificial Sequence: Synthetic Peptide
HSDGTFTSDLSKQMEEEAVRLFIEWLKNGGPSSGAPPPSK

SEQ ID NO: 374 - protein, 31 aa, Artificial Sequence
  Description of Artificial Sequence: Synthetic Peptide
HGEGTFTSDLSKEMEEEVRLFIEWLKNGGPY

SEQ ID NO: 375 - protein, 30 aa, Artificial Sequence
  Description of Artificial Sequence: Synthetic Peptide
HGEGTFTSDLSKEMEEEVRLFIEWLKNGGY

SEQ ID NO: 376 - protein, 29 aa, Artificial Sequence
  Description of Artificial Sequence: Synthetic Peptide
DLSKQMEEEAVRLFIEWLKGGPSSGPPPS

SEQ ID NO: 377 - protein, 31 aa, Artificial Sequence
  Description of Artificial Sequence: Synthetic Peptide
EAEDLQVGQVELGGGPGAGSLQPLALEGSLQ

SEQ ID NO: 378 - protein, 32 aa, Artificial Sequence
  Description of Artificial Sequence: Synthetic Peptide
YEAEDLQVGQVELGGGPGAGSLQPLALEGSLQ

SEQ ID NO: 379 - protein, 51 aa, Artificial Sequence
  Description of Artificial Sequence: Synthetic Peptide
GIVEQCCTSICSLYQLENYCNFVNQHLCGSHLVEALYLVCGERGFFYTPKT

SEQ ID NO: 380 - protein, 16 aa, Artificial Sequence
  Description of Artificial Sequence: Synthetic Peptide
DVSTPPTVLPDNFPRY

SEQ ID NO: 381 - protein, 35 aa, Artificial Sequence
  Description of Artificial Sequence: Synthetic Peptide
RDVSTPPTVLPDNFPRYPVGKFFQYDTWKQSTQRL

SEQ ID NO: 382 - protein, 24 aa, Artificial Sequence
  Description of Artificial Sequence: Synthetic Peptide
GLPALLRARRGHVLAKELEAFREA

SEQ ID NO: 383 - protein, 36 aa, Artificial Sequence
  Description of Artificial Sequence: Synthetic Peptide
YPSKPDNPGEDAPAEDMARYYSALRHYINLLTRPRY

SEQ ID NO: 384 - protein, 39 aa, Artificial Sequence
  Description of Artificial Sequence: Synthetic Peptide
PDKDFIVNPSDLVLDNKAALRDYLRQINEYFAIIGRPRF

SEQ ID NO: 385 - protein, 3 aa, Artificial Sequence
  Description of Artificial Sequence: Synthetic Peptide
FMR

SEQ ID NO: 386 - protein, 8 aa, Artificial Sequence
  Description of Artificial Sequence: Synthetic Peptide
CWRYCWRY

SEQ ID NO: 387 - protein, 36 aa, Artificial Sequence
  Description of Artificial Sequence: Synthetic Peptide
YPSKPDNPGEDAPAEDMARYYSALRHYINLITRQRY

SEQ ID NO: 388 - protein, 24 aa, Artificial Sequence
  Description of Artificial Sequence: Synthetic Peptide
YPSKPDNPGEDAPAEDMARYYSAL

SEQ ID NO: 389 - protein, 8 aa, Artificial Sequence
  Description of Artificial Sequence: Synthetic Peptide
IGPYRLRY

SEQ ID NO: 390 - protein, 36 aa, Artificial Sequence
  Description of Artificial Sequence: Synthetic Peptide
GPSQPTYPGDDAPVEDLIRFYDNLQQYLNVVTRHRY

SEQ ID NO: 391 - protein, 36 aa, Artificial Sequence
  Description of Artificial Sequence: Synthetic Peptide
APLEPVYPGDNATPEQMAQYAADLRRYINMLTRPRY

SEQ ID NO: 392 - protein, 6 aa, Artificial Sequence
  Description of Artificial Sequence: Synthetic Peptide
LTRPRY

SEQ ID NO: 393 - protein, 6 aa, Artificial Sequence
  Description of Artificial Sequence: Synthetic Peptide
LTRPRY

SEQ ID NO: 394 - protein, 36 aa, Artificial Sequence
  Description of Artificial Sequence: Synthetic Peptide
APSEPHHPGDQATQDQLAQYYSDLYQYITFVTRPRF

SEQ ID NO: 395 - protein, 36 aa, Artificial Sequence
  Description of Artificial Sequence: Synthetic Peptide
APLEPMYPGDYATHEQRAQYETQLRRYINTLTRPRY

SEQ ID NO: 396 - protein, 36 aa, Artificial Sequence
  Description of Artificial Sequence: Synthetic Peptide
YPPKPENPGEDAPPEELAKYYTALRHYINLITRQRY

SEQ ID NO: 397 - protein, 36 aa, Artificial Sequence
  Description of Artificial Sequence: Synthetic Peptide
YPIKPEAPGEDASPEELNRYYASLRHYLNLVTRQRY

SEQ ID NO: 398 - protein, 34 aa, Artificial Sequence
  Description of Artificial Sequence: Synthetic Peptide
IKPEAPGEDASPEELNRYYASLRHYLNLVTRQRY

SEQ ID NO: 399 - protein, 36 aa, Artificial Sequence
  Description of Artificial Sequence: Synthetic Peptide
YPAKPEAPGEDASPEELSRYYASLRHYLNLVTRQRY

SEQ ID NO: 400 - protein, 36 aa, Artificial Sequence
  Description of Artificial Sequence: Synthetic Peptide
YPIKPEAPGEDASPEELNRYYASLRHYLNLLTRPRY

SEQ ID NO: 401 - protein, 10 aa, Artificial Sequence
  Description of Artificial Sequence: Synthetic Peptide
EQDYTGWMDF

SEQ ID NO: 402 - protein, 33 aa, Artificial Sequence
  Description of Artificial Sequence: Synthetic Peptide
KAPSGRMSIVKNLQNLDPSHRISDRDYMGWMDF

SEQ ID NO: 403 - protein, 4 aa, Artificial Sequence
  Description of Artificial Sequence: Synthetic Peptide
DYMG

SEQ ID NO: 404 - protein, 8 aa, Artificial Sequence [sequence omitted]

SEQ ID NO: 405 - protein, 8 aa, Artificial Sequence [sequence omitted]

SEQ ID NO: 406 - protein, 7 aa, Artificial Sequence
  Description of Artificial Sequence: Synthetic Peptide
YMGWMDF

SEQ ID NO: 407 - protein, 4 aa, Artificial Sequence
  Description of Artificial Sequence: Synthetic Peptide
WMDF

SEQ ID NO: 408 - protein, 33 aa, Artificial Sequence
  Description of Artificial Sequence: Synthetic Peptide
KAPSGRVSMIKNLQSLDPSHRISDRDYMGWMDF

SEQ ID NO: 409 - skipped

SEQ ID NO: 410 - protein, 9 aa, Artificial Sequence
  Description of Artificial Sequence: Synthetic Peptide
SAEEYEYPS

SEQ ID NO: 411 - protein, 5 aa, Artificial Sequence
  Description of Artificial Sequence: Synthetic Peptide
DYMGW

SEQ ID NO: 412 - protein, 6 aa, Artificial Sequence
  Description of Artificial Sequence: Synthetic Peptide
DYMGWM

SEQ ID NO: 413 - protein, 9 aa, Artificial Sequence
  Description of Artificial Sequence: Synthetic Peptide
VPVEAVDPM

SEQ ID NO: 414 - skipped

SEQ ID NO: 415 - protein, 8 aa, Artificial Sequence [sequence omitted]

SEQ ID NO: 416 - protein, 23 aa, Artificial Sequence
  Description of Artificial Sequence: Synthetic Peptide
MKVAIIFLLSALALLNLAGNTTA

SEQ ID NO: 417 - protein, 27 aa, Artificial Sequence
  Description of Artificial Sequence: Synthetic Peptide
VPLPAGGGTVLTKMYPRGNHWAVGHLM

SEQ ID NO: 418 - protein, 16 aa, Artificial Sequence
  Description of Artificial Sequence: Synthetic Peptide
VPLPAGGGTVLTKMYP

SEQ ID NO: 419 - protein, 27 aa, Artificial Sequence
  Description of Artificial Sequence: Synthetic Peptide
APVSVGGGTVLAKMYPRGNHWAVGHLM

SEQ ID NO: 420 - protein, 14 aa, Artificial Sequence
  Description of Artificial Sequence: Synthetic Peptide
MYPRGNHWAVGHLM

SEQ ID NO: 421 - protein, 36 aa, Artificial Sequence
  Description of Artificial Sequence: Synthetic Peptide
FLPHVFAELSDRKGFVQGNGAVEALHDHFYPDWMDF

SEQ ID NO: 422 - protein, 17 aa, Artificial Sequence
  Description of Artificial Sequence: Synthetic Peptide
EGPWLEEEEEAYGWMDF

SEQ ID NO: 423 - protein, 34 aa, Artificial Sequence
  Description of Artificial Sequence: Synthetic Peptide
ELGPQGPPHLVADPSKKQGPWLEEEEEAYGWMDF

SEQ ID NO: 424 - protein, 17 aa, Artificial Sequence
  Description of Artificial Sequence: Synthetic Peptide
ERPPMEEEEEAYGWMDF

SEQ ID NO: 425 - protein, 5 aa, Artificial Sequence
  Description of Artificial Sequence: Synthetic Peptide
AWMDF

SEQ ID NO: 426 - protein, 42 aa, Artificial Sequence
  Description of Artificial Sequence: Synthetic Peptide
YAEGTFISDYSIAMDKIHQQDFVNWLLAQKGKKNDWKHNITQ

SEQ ID NO: 427 - protein, 42 aa, Artificial Sequence
  Description of Artificial Sequence: Synthetic Peptide
YAEGTFISDYSIAMDKIRQQDFVNWLLAQKGKKSDWKHNITQ

SEQ ID NO: 428 - protein, 30 aa, Artificial Sequence
  Description of Artificial Sequence: Synthetic Peptide
YAEGTFISDYSIAMDKIRQQDFVNWLLAQK

SEQ ID NO: 429 - protein, 30 aa, Artificial Sequence; identical to SEQ ID NO: 428
  Description of Artificial Sequence: Synthetic Peptide

SEQ ID NO: 430 - protein, 22 aa, Artificial Sequence
  Description of Artificial Sequence: Synthetic Peptide
FVPIFTHSELQKIREKERNKGQ

SEQ ID NO: 431 - protein, 22 aa, Artificial Sequence
  Description of Artificial Sequence: Synthetic Peptide
FVPIFTYGELQRMQEKERNKGQ

SEQ ID NO: 432 - protein, 22 aa, Artificial Sequence
  Description of Artificial Sequence: Synthetic Peptide
FVPIFTYGELQRLQEKERNKGQ

SEQ ID NO: 433 - protein, 21 aa, Artificial Sequence
  Description of Artificial Sequence: Synthetic Peptide
FVPIFTYGELRLQEKERNKGQ

SEQ ID NO: 434 - protein, 9 aa, Artificial Sequence
  Description of Artificial Sequence: Synthetic Peptide
IARRHPYFL

SEQ ID NO: 435 - protein, 27 aa, Artificial Sequence
  Description of Artificial Sequence: Synthetic Peptide
HSDGTFTSELSRLRESARLQRLLQGLV

SEQ ID NO: 436 - protein, 27 aa, Artificial Sequence
  Description of Artificial Sequence: Synthetic Peptide
HSDGLFTSEYSKMRGNAQVQKFIQNLM

SEQ ID NO: 437 - protein, 27 aa, Artificial Sequence
  Description of Artificial Sequence: Synthetic Peptide
HSDGTFTSELSRLREGARLQRLLQGLV

SEQ ID NO: 438 - protein, 27 aa, Artificial Sequence
  Description of Artificial Sequence: Synthetic Peptide
HSDGTFTSELSRLRDSARLQRLLQGLV

SEQ ID NO: 439 - protein, 27 aa, Artificial Sequence
  Description of Artificial Sequence: Synthetic Peptide
HSDGTFTSELSRLQDSARLQRLLQGLV

SEQ ID NO: 440 - protein, 26 aa, Artificial Sequence
  Description of Artificial Sequence: Synthetic Peptide
SDGTFTSELSRLRDSARLQRLLGGLV

SEQ ID NO: 441 - protein, 32 aa, Artificial Sequence
  Description of Artificial Sequence: Synthetic Peptide
AAMLASQTEAFVPIFTYGELQRMQEKERNKGQ

SEQ ID NO: 442 - protein, 28 aa, Artificial Sequence
  Description of Artificial Sequence: Synthetic Peptide
HSDAVFTDNYTRLRRQLAVRRYLNSILN

SEQ ID NO: 443 - protein, 31 aa, Artificial Sequence
  Description of Artificial Sequence: Synthetic Peptide
HSDAVFTDNYTRLRRQLAVRRYLNSILNGKR

SEQ ID NO: 444 - protein, 12 aa, Artificial Sequence
  Description of Artificial Sequence: Synthetic Peptide
MAVKKYLNSILN

SEQ ID NO: 445 - protein, 27 aa, Artificial Sequence
  Description of Artificial Sequence: Synthetic Peptide
HADGVFTSDFSRLLGQLSAKKYLESLI

SEQ ID NO: 446 - protein, 27 aa, Artificial Sequence
  Description of Artificial Sequence: Synthetic Peptide
HADGVFTSDYSRLLGQISAKKYLESLI

SEQ ID NO: 447 - protein, 27 aa, Artificial Sequence
  Description of Artificial Sequence: Synthetic Peptide
HADGVFTSDFSKLLGQLSAKKYLESLM

SEQ ID NO: 448 - protein, 42 aa, Artificial Sequence
  Description of Artificial Sequence: Synthetic Peptide
HADGVFTSDFSKLLGQLSAKKYLESLMGKRVSSNISEDPVPV

SEQ ID NO: 449 - protein, 12 aa, Artificial Sequence
  Description of Artificial Sequence: Synthetic Peptide
VSSNISEDPVPV

SEQ ID NO: 450 - protein, 15 aa, Artificial Sequence
  Description of Artificial Sequence: Synthetic Peptide
SSEGESPDFPEELEK

SEQ ID NO: 451 - protein, 21 aa, Artificial Sequence
  Description of Artificial Sequence: Synthetic Peptide
CSCNSWLDKECVYFCHLDIIW

SEQ ID NO: 452 - protein, 28 aa, Artificial Sequence
  Description of Artificial Sequence: Synthetic Peptide
HSDAVFTDNYSRFRKQMAVKKYLNSVLT

SEQ ID NO: 453 - protein, 28 aa, Artificial Sequence
  Description of Artificial Sequence: Synthetic Peptide
HSDALFTDTYTRLRKQMAMKKYLNSVLN

SEQ ID NO: 454 - protein, 28 aa, Artificial Sequence
  Description of Artificial Sequence: Synthetic Peptide
HSDAVFTDNYTRLRKQMAVKKYLNSILN

SEQ ID NO: 455 - protein, 28 aa, Artificial Sequence
  Description of Artificial Sequence: Synthetic Peptide
HSDAVFTDNYTRLRKQMAVKKYLNSILN

SEQ ID NO: 456 - protein, 12 aa, Artificial Sequence
  Description of Artificial Sequence: Synthetic Peptide
HSDAVFTDNYTR

SEQ ID NO: 457 - protein, 19 aa, Artificial Sequence
  Description of Artificial Sequence: Synthetic Peptide
YTRLRKQMAVKKYLNSILN

SEQ ID NO: 458 - protein, 18 aa, Artificial Sequence
  Description of Artificial Sequence: Synthetic Peptide
TRLRKQMAVKKYLNSILN

SEQ ID NO: 459 - protein, 27 aa, Artificial Sequence
  Description of Artificial Sequence: Synthetic Peptide
HSDAVFTDNSRFRKQMAAKKYLNSVLA

SEQ ID NO: 460 - protein, 23 aa, Artificial Sequence
  Description of Artificial Sequence: Synthetic Peptide
FTDNYTRLRKQMAVKKYLNSILN

SEQ ID NO: 461 - protein, 28 aa, Artificial Sequence
  Description of Artificial Sequence: Synthetic Peptide
KPRRPYTDNYTRLRKQMAVKKYLNSILN

SEQ ID NO: 462 - protein, 29 aa, Artificial Sequence
  Description of Artificial Sequence: Synthetic Peptide
YFDAIFTNSYRKVLGQLSARKLLQDIMSR

SEQ ID NO: 463 - protein, 28 aa, Artificial Sequence
  Description of Artificial Sequence: Synthetic Peptide
HSDAVFTDNYTRLRKQLAVKKYLNSILN

SEQ ID NO: 464 - protein, 8 aa, Artificial Sequence
  Description of Artificial Sequence: Synthetic Peptide
LMYPTYLK

SEQ ID NO: 465 - protein, 29 aa, Artificial Sequence
  Description of Artificial Sequence: Synthetic Peptide
MMRDSGCFGRRIDRIGSLSGMGCNGSRKN

SEQ ID NO: 466 - protein, 15 aa, Artificial Sequence
  Description of Artificial Sequence: Synthetic Peptide
GFIWGNIFGHYSGDF

SEQ ID NO: 467 - protein, 11 aa, Artificial Sequence
  Description of Artificial Sequence: Synthetic Peptide
SLRRSSCFGGR

SEQ ID NO: 468 - protein, 24 aa, Artificial Sequence
  Description of Artificial Sequence: Synthetic Peptide
SSDCFGSRIDRIGAQSGMGCGRRF

SEQ ID NO: 469 - protein, 20 aa, Artificial Sequence
  Description of Artificial Sequence: Synthetic Peptide
CFGSRIDRIGAQSGMGCGRF

SEQ ID NO: 470 - protein, 21 aa, Artificial Sequence
  Description of Artificial Sequence: Synthetic Peptide
CFGSRIDRIGAQSGMGCGRRF

SEQ ID NO: 471 - protein, 24 aa, Artificial Sequence
  Description of Artificial Sequence: Synthetic Peptide
SSDCFGSRIDRIGAQSGMGCGRRF

SEQ ID NO: 472 - protein, 30 aa, Artificial Sequence
  Description of Artificial Sequence: Synthetic Peptide
APRSMRRSSDCFGSRIDRIGAQSGMGCGRF

SEQ ID NO: 473 - protein, 24 aa, Artificial Sequence
  Description of Artificial Sequence: Synthetic Peptide
SSCFGGRMDRIGAQSGLGCNSFRY

SEQ ID NO: 474 - protein, 17 aa, Artificial Sequence
  Description of Artificial Sequence: Synthetic Peptide
CFGGRMDRIGAQSGLGC

SEQ ID NO: 475 - protein, 22 aa, Artificial Sequence
  Description of Artificial Sequence: Synthetic Peptide
CFGGRMDRIGAQSGLGCNSFRY

SEQ ID NO: 476 - protein, 28 aa, Artificial Sequence
  Description of Artificial Sequence: Synthetic Peptide
SLRRSSCFGGRMDRIGAQSGLGCNSFRY

SEQ ID NO: 477 - protein, 11 aa, Artificial Sequence
  Description of Artificial Sequence: Synthetic Peptide
RCGGRIDRIRC

SEQ ID NO: 478 - protein, 26 aa, Artificial Sequence
  Description of Artificial Sequence: Synthetic Peptide
RRSSCFGGRIDRIGAQSGLGCNSFRY

SEQ ID NO: 479 - protein, 26 aa, Artificial Sequence
  Description of Artificial Sequence: Synthetic Peptide
RRSSCFGGRMDRIGAQSGLGCNSFRY

SEQ ID NO: 480 - protein, 25 aa, Artificial Sequence
  Description of Artificial Sequence: Synthetic Peptide
RSSCFGGRMDRIGAQSGLGCNSFRY

SEQ ID NO: 481 - protein, 23 aa, Artificial Sequence
  Description of Artificial Sequence: Synthetic Peptide
SSCFGGRMDRIGAQSGLGCNSFR

SEQ ID NO: 482 - protein, 27 aa, Artificial Sequence
  Description of Artificial Sequence: Synthetic Peptide
SKSSSPCFGGKLDRIGSYSGLGCNSRK

SEQ ID NO: 483 - protein, 21 aa, Artificial Sequence
  Description of Artificial Sequence: Synthetic Peptide
SSCFGGRIDRIGAQSGLGCNS

SEQ ID NO: 484 - protein, 23 aa, Artificial Sequence
  Description of Artificial Sequence: Synthetic Peptide
SSCFGGRIDRIGAQSGLGCNSFR

SEQ ID NO: 485 - protein, 24 aa, Artificial Sequence
  Description of Artificial Sequence: Synthetic Peptide
SSCFGGRIDRIGAQSGLGCNSFRY

SEQ ID NO: 486 - protein, 28 aa, Artificial Sequence
  Description of Artificial Sequence: Synthetic Peptide
SLRRSSCFGGRIDRIGAQSGLGCNSFRY

SEQ ID NO: 487 - protein, 24 aa, Artificial Sequence
  Description of Artificial Sequence: Synthetic Peptide
RSSCFGGRIDRIGAQSGLGCNSFR

SEQ ID NO: 488 - protein, 25 aa, Artificial Sequence
  Description of Artificial Sequence: Synthetic Peptide
RSSCFGGRIDRIGAQSGLGCNSFRY

SEQ ID NO: 489 - protein, 56 aa, Artificial Sequence
  Description of Artificial Sequence: Synthetic Peptide
SLRRSSCFGGRMDRIGAQSGLGCNSFRYSLRRSSCFGGRMDRIGAQSGLGCNSFRY

SEQ ID NO: 490 - protein, 32 aa, Artificial Sequence
  Description of Artificial Sequence: Synthetic Peptide
AGPRSLRRSSCFGGRIDRIGAQSGLGCNSFRY

SEQ ID NO: 491 - protein, 27 aa, Artificial Sequence
  Description of Artificial Sequence: Synthetic Peptide
SKSSSPCFGGKLDRIGSYSGLGCNSRK

SEQ ID NO: 492 - protein, 16 aa, Artificial Sequence
  Description of Artificial Sequence: Synthetic Peptide
NPMYNAVSNADLMDFK

SEQ ID NO: 493 - protein, 15 aa, Artificial Sequence
  Description of Artificial Sequence: Synthetic Peptide
RSSCFGGRIDRIGAC

SEQ ID NO: 494 - protein, 21 aa, Artificial Sequence
  Description of Artificial Sequence: Synthetic Peptide
SFGGRIDRIGAQSGLGNSFRY

SEQ ID NO: 495 - protein, 28 aa, Artificial Sequence
  Description of Artificial Sequence: Synthetic Peptide
SLRRSSCFGGRMDRIGAQSGLGCNSFRY

SEQ ID NO: 496 - protein, 21 aa, Artificial Sequence
  Description of Artificial Sequence: Synthetic Peptide
FAGRIDRIGAQSGLGCNSFRY

SEQ ID NO: 497 - protein, 13 aa, Artificial Sequence
  Description of Artificial Sequence: Synthetic Peptide
SSDRSALLKSKLR

SEQ ID NO: 498 - protein, 30 aa, Artificial Sequence
  Description of Artificial Sequence: Synthetic Peptide
NPMYNAVSNADLMDFKNLLDHLEEKMPLED

SEQ ID NO: 499 - protein, 37 aa, Artificial Sequence
  Description of Artificial Sequence: Synthetic Peptide
EVVPPQVLSEPNEEAGAALSPLPEVPPWTGEVSPAQR

SEQ ID NO: 500 - protein, 20 aa, Artificial Sequence
  Description of Artificial Sequence: Synthetic Peptide
SSDRSALLKSKLRALLTAPR

SEQ ID NO: 501 - protein, 27 aa, Artificial Sequence
  Description of Artificial Sequence: Synthetic Peptide
SKSSSPCFGGKLDRIGSYSGLGCNSRK

SEQ ID NO: 502 - protein, 24 aa, Artificial Sequence
  Description of Artificial Sequence: Synthetic Peptide
YSSCFGGRIDRIGAQSGLGCNSFR

SEQ ID NO: 503 - protein, 21 aa, Artificial Sequence
  Description of Artificial Sequence: Synthetic Peptide
YSSDRSALLKSKLRALLTAPR

SEQ ID NO: 504 - protein, 32 aa, Artificial Sequence
  Description of Artificial Sequence: Synthetic Peptide
TAPRSLRRSSCFGGRMDRIGAQSGLGCNSFRY

SEQ ID NO: 505 - protein, 24 aa, Artificial Sequence
  Description of Artificial Sequence: Synthetic Peptide
YSSCFGGRIDRIGAQSGLGCNSFR

SEQ ID NO: 506 - protein, 35 aa, Artificial Sequence
  Description of Artificial Sequence: Synthetic Peptide
SFNSCFGNRIERIGSWSGLGCNNVKTGNKKRIFGN

SEQ ID NO: 507 - protein, 32 aa, Artificial Sequence
  Description of Artificial Sequence: Synthetic Peptide
SPKMMHKSGCFGRRLDRIGSLSGLGCNVLRKY

SEQ ID NO: 508 - protein, 22 aa, Artificial Sequence
  Description of Artificial Sequence: Synthetic Peptide
GWNRGCFGLKLDRIGSLSGLGC

SEQ ID NO: 509 - protein, 32 aa, Artificial Sequence
  Description of Artificial Sequence: Synthetic Peptide
SPKMVQGSGCFGRKMDRISSSSGLGCKVLRRH

SEQ ID NO: 510 - protein, 45 aa, Artificial Sequence
  Description of Artificial Sequence: Synthetic Peptide
SQGSTLRVQQRPQNSKVTHISSCFGHKIDRIGSVSRLGCNALKLL

SEQ ID NO: 511 - protein, 26 aa, Artificial Sequence
  Description of Artificial Sequence: Synthetic Peptide
DSGCFGRRLDRIGSLSGLGCNVLRRY

SEQ ID NO: 512 - protein, 32 aa, Artificial Sequence
  Description of Artificial Sequence: Synthetic Peptide
SPKTMRDSGCFGRRLDRIGSLSGLGCNVLRRY

SEQ ID NO: 513 - protein, 32 aa, Artificial Sequence
  Description of Artificial Sequence: Synthetic Peptide
NSKMAHSSSCFGQKIDRIGAVSRLGCDGLRLF

SEQ ID NO: 514 - protein, 45 aa, Artificial Sequence
  Description of Artificial Sequence: Synthetic Peptide
SQDSAFRIQERLRNSKMAHSSSCFGQKIDRIGAVSRLGCDGLRLF

SEQ ID NO: 515 - protein, 33 aa, Artificial Sequence
  Description of Artificial Sequence: Synthetic Peptide
YSPKMVQGSGCFGRKMDRLSSSSGLGCKVLRRH

SEQ ID NO: 516 - protein, 32 aa, Artificial Sequence; identical to SEQ ID NO: 509
  Description of Artificial Sequence: Synthetic Peptide

SEQ ID NO: 517 - protein, 22 aa, Artificial Sequence
  Description of Artificial Sequence: Synthetic Peptide
GLSKGCFGLKLDRIGSMSGLGC

SEQ ID NO: 518 - protein, 22 aa, Artificial Sequence
  Description of Artificial Sequence: Synthetic Peptide
GLSRSCFGVKLDRIGSMSGLGC

SEQ ID NO: 519 - protein, 53 aa, Artificial Sequence
  Description of Artificial Sequence: Synthetic Peptide
DLRVDTKSRAAWARLLQEHPNARKYKGANKKGLSKGCFGLKLDRIGSMSGLGC

SEQ ID NO: 520 - protein, 53 aa, Artificial Sequence
  Description of Artificial Sequence: Synthetic Peptide
DLRVDTKSRAAWARLLHEHPNARKYKGGNKKGLSKGCFGLKLDRIGSMSGLGC

SEQ ID NO: 521 - protein, 27 aa, Artificial Sequence
  Description of Artificial Sequence: Synthetic Peptide
KPGTPPKVPRTPPGEELAEPQAAGGNQ

SEQ ID NO: 522 - protein, 21 aa, Artificial Sequence
  Description of Artificial Sequence: Synthetic Peptide
GDKTPGGGGANLKGDRSRLLR

SEQ ID NO: 523 - protein, 27 aa, Artificial Sequence
  Description of Artificial Sequence: Synthetic Peptide
GLSKGCFGLKLDRIGSMSGLGCNSFRY

SEQ ID NO: 524 - protein, 23 aa, Artificial Sequence
  Description of Artificial Sequence: Synthetic Peptide
YGLSKGCFGLKLDRIGSMSGLGC

SEQ ID NO: 525 - protein, 7 aa, Artificial Sequence
  Description of Artificial Sequence: Synthetic Peptide
DAFVALM

SEQ ID NO: 526 - protein, 7 aa, Artificial Sequence
  Description of Artificial Sequence: Synthetic Peptide
DAFVALM

SEQ ID NO: 527 - protein, 11 aa, Artificial Sequence
  Description of Artificial Sequence: Synthetic Peptide
EPSKDAFIGLM

SEQ ID NO: 528 - protein, 9 aa, Artificial Sequence
  Description of Artificial Sequence: Synthetic Peptide
GPSGFYGVR

SEQ ID NO: 529 - protein, 10 aa, Artificial Sequence
  Description of Artificial Sequence: Synthetic Peptide
APLSGFYGVR

SEQ ID NO: 530 - protein, 7 aa, Artificial Sequence
  Description of Artificial Sequence: Synthetic Peptide
DSFVGLM

SEQ ID NO: 531 - protein, 10 aa, Artificial Sequence
  Description of Artificial Sequence: Synthetic Peptide
HKTDSFVGLM

SEQ ID NO: 532 - protein, 10 aa, Artificial Sequence
  Description of Artificial Sequence: Synthetic Peptide
HKINSFVGLM

SEQ ID NO: 533 - protein, 11 aa, Artificial Sequence
  Description of Artificial Sequence: Synthetic Peptide
YHKTDSFVGLM

SEQ ID NO: 534 - protein, 10 aa, Artificial Sequence
  Description of Artificial Sequence: Synthetic Peptide
HKTDSYVGLM

SEQ ID NO: 535 - protein, 7 aa, Artificial Sequence
  Description of Artificial Sequence: Synthetic Peptide
KDSFVGM

SEQ ID NO: 536 - protein, 6 aa, Artificial Sequence
  Description of Artificial Sequence: Synthetic Peptide
RAWFPP

SEQ ID NO: 537 - protein, 6 aa, Artificial Sequence
  Description of Artificial Sequence: Synthetic Peptide
AAWFPP

SEQ ID NO: 538 - protein, 6 aa, Artificial Sequence
  Description of Artificial Sequence: Synthetic Peptide
AAWFPP

SEQ ID NO: 539 - protein, 7 aa, Artificial Sequence
  Description of Artificial Sequence: Synthetic Peptide
DSFVALM

SEQ ID NO: 540 - protein, 6 aa, Artificial Sequence
  Description of Artificial Sequence: Synthetic Peptide
DSFVGL

SEQ ID NO: 541 - protein, 7 aa, Artificial Sequence
  Description of Artificial Sequence: Synthetic Peptide
DSFWALM

SEQ ID NO: 542 - protein, 7 aa, Artificial Sequence
  Description of Artificial Sequence: Synthetic Peptide
DYWVWWR

SEQ ID NO: 543 - protein, 7 aa, Artificial Sequence
  Description of Artificial Sequence: Synthetic Peptide
DYWVWWK

SEQ ID NO: 544 - protein, 10 aa, Artificial Sequence
  Description of Artificial Sequence: Synthetic Peptide
DMHDFFVGLM

SEQ ID NO: 545 - protein, 9 aa, Artificial Sequence
  Description of Artificial Sequence: Synthetic Peptide
DMHDFFGLM

SEQ ID NO: 546 - protein, 10 aa, Artificial Sequence
  Description of Artificial Sequence: Synthetic Peptide
DMHDFFPGLM

SEQ ID NO: 547 - protein, 11 aa, Artificial Sequence
  Description of Artificial Sequence: Synthetic Peptide
YDMHDFFVGLM

SEQ ID NO: 548 - protein, 9 aa, Artificial Sequence
  Description of Artificial Sequence: Synthetic Peptide
DPHDFWVWL

SEQ ID NO: 549 - protein, 10 aa, Artificial Sequence
  Description of Artificial Sequence: Synthetic Peptide
GNLWATGHFM

SEQ ID NO: 550 - protein, 30 aa, Artificial Sequence
  Description of Artificial Sequence: Synthetic Peptide
LSWDLPEPRSRAGKIRVHPRGNLWATGHFM

SEQ ID NO: 551 - protein, 32 aa, Artificial Sequence
  Description of Artificial Sequence: Synthetic Peptide
APLSWDLPEPRSRAGKIRVHPRGNLWATGHFM

SEQ ID NO: 552 - protein, 5 aa, Artificial Sequence
  Description of Artificial Sequence: Synthetic Peptide
CYWVC

SEQ ID NO: 553 - protein, 10 aa, Artificial Sequence
  Description of Artificial Sequence: Synthetic Peptide
GNHWAVGHLM

SEQ ID NO: 554 - protein, 6 aa, Artificial Sequence
  Description of Artificial Sequence: Synthetic Peptide
KIPYIL

SEQ ID NO: 555 - protein, 8 aa, Artificial Sequence
  Description of Artificial Sequence: Synthetic Peptide
YFLFRPRN

SEQ ID NO: 556 - protein, 25 aa, Artificial Sequence
  Description of Artificial Sequence: Synthetic Peptide
FKVDEEFQGPIVSQNRRYFLFRPRN

SEQ ID NO: 557 - protein, 23 aa, Artificial Sequence
  Description of Artificial Sequence: Synthetic Peptide
YKVNEYQGPVAPSGGFFLFRPRN

SEQ ID NO: 558 - protein, 21 aa, Artificial Sequence
  Description of Artificial Sequence: Synthetic Peptide
DAGHGQISHKRHKTDSFVGLM

SEQ ID NO: 559 - protein, 10 aa, Artificial Sequence
  Description of Artificial Sequence: Synthetic Peptide
PNPDEFVGLM

SEQ ID NO: 560 - protein, 9 aa, Artificial Sequence
  Description of Artificial Sequence: Synthetic Peptide
ELWAVGSFM

SEQ ID NO: 561 - protein, 9 aa, Artificial Sequence
  Description of Artificial Sequence: Synthetic Peptide
ELWAVGSLM

SEQ ID NO: 562 - protein, 11 aa, Artificial Sequence
  Description of Artificial Sequence: Synthetic Peptide
EADPNKFYGLM

SEQ ID NO: 563 - protein, 8 aa, Artificial Sequence
  Description of Artificial Sequence: Synthetic Peptide
EADPNKFY

SEQ ID NO: 564 - protein, 18 aa, Artificial Sequence
  Description of Artificial Sequence: Synthetic Peptide
SPSNSKCPDGPDCFVGLM

SEQ ID NO: 565 - protein, 5 aa, Artificial Sequence
  Description of Artificial Sequence: Synthetic Peptide
DFGLM

SEQ ID NO: 566 - protein, 6 aa, Artificial Sequence
  Description of Artificial Sequence: Synthetic Peptide
DDFGLM

SEQ ID NO: 567 - protein, 10 aa, Artificial Sequence
  Description of Artificial Sequence: Synthetic Peptide
GSHWAVGHLM

SEQ ID NO: 568 - protein, 23 aa, Artificial Sequence
  Description of Artificial Sequence: Synthetic Peptide
GKRDADSSIEKQVALLKALYGHG

SEQ ID NO: 569 - protein, 19 aa, Artificial Sequence
  Description of Artificial Sequence: Synthetic Peptide
ALNSVAYERSAMQNYERRR

SEQ ID NO: 570 - protein, 17 aa, Artificial Sequence
  Description of Artificial Sequence: Synthetic Peptide
KWCFRVCYRGICYRRCR

SEQ ID NO: 571 - protein, 8 aa, Artificial Sequence
  Description of Artificial Sequence: Synthetic Peptide
EGKRPWIL

SEQ ID NO: 572 - protein, 25 aa, Artificial Sequence
  Description of Artificial Sequence: Synthetic Peptide
MLTKFETKSARVKGLSFHPKRPWIL

SEQ ID NO: 573 - protein, 10 aa, Artificial Sequence
  Description of Artificial Sequence: Synthetic Peptide
DMHDFFVGLM

SEQ ID NO: 574 - protein, 10 aa, Artificial Sequence
  Description of Artificial Sequence: Synthetic Peptide
HKTDSFVGLM

SEQ ID NO: 575 - protein, 24 aa, Artificial Sequence
  Description of Artificial Sequence: Synthetic Peptide
DADSSIEKQVALLKALYGHGQISH

SEQ ID NO: 576 - protein, 7 aa, Artificial Sequence
  Description of Artificial Sequence: Synthetic Peptide
EQWFWWM

SEQ ID NO: 577 - protein, 5 aa, Artificial Sequence
  Description of Artificial Sequence: Synthetic Peptide
RFFLM

SEQ ID NO: 578 - protein, 11 aa, Artificial Sequence
  Description of Artificial Sequence: Synthetic Peptide
RPRPQQFFGLM

SEQ ID NO: 579 - protein, 6 aa, Artificial Sequence
  Description of Artificial Sequence: Synthetic Peptide
RWFWLM

SEQ ID NO: 580 - protein, 2 aa, Artificial Sequence
  Description of Artificial Sequence: Synthetic Peptide
WM

SEQ ID NO: 581 - protein, 5 aa, Artificial Sequence
  Description of Artificial Sequence: Synthetic Peptide
RFFLM

SEQ ID NO: 582 - protein, 6 aa, Artificial Sequence
  Description of Artificial Sequence: Synthetic Peptide
RWFWLM

SEQ ID NO: 583 - protein, 8 aa, Artificial Sequence
  Description of Artificial Sequence: Synthetic Peptide
AQQFFGLM

SEQ ID NO: 584 - protein, 6 aa, Artificial Sequence
  Description of Artificial Sequence: Synthetic Peptide
YFFHLM

SEQ ID NO: 585 - protein, 11 aa, Artificial Sequence
  Description of Artificial Sequence: Synthetic Peptide
RPKPQQFYGLM

SEQ ID NO: 586 - protein, 10 aa, Artificial Sequence
  Description of Artificial Sequence: Synthetic Peptide
RPKPQQFFLM

SEQ ID NO: 587 - protein, 11 aa, Artificial Sequence
  Description of Artificial Sequence: Synthetic Peptide
RPKPQQFFHLM

SEQ ID NO: 588 - protein, 11 aa, Artificial Sequence
  Description of Artificial Sequence: Synthetic Peptide
RPKPQQFFWLM

SEQ ID NO: 589 - protein, 11 aa, Artificial Sequence
  Description of Artificial Sequence: Synthetic Peptide
RPKPQQWFWLM

SEQ ID NO: 590 - protein, 11 aa, Artificial Sequence
  Description of Artificial Sequence: Synthetic Peptide
RPKPFQWFWLL

SEQ ID NO: 591 - protein, 11 aa, Artificial Sequence
  Description of Artificial Sequence: Synthetic Peptide
RPKPQQFFPLM

SEQ ID NO: 592 - protein, 8 aa, Artificial Sequence
  Description of Artificial Sequence: Synthetic Peptide
PQQFFGLM

SEQ ID NO: 593 - protein, 5 aa, Artificial Sequence
  Description of Artificial Sequence: Synthetic Peptide
QFFLM

SEQ ID NO: 594 - protein, 5 aa, Artificial Sequence
  Description of Artificial Sequence: Synthetic Peptide
QFFLM

SEQ ID NO: 595 - protein, 6 aa, Artificial Sequence
  Description of Artificial Sequence: Synthetic Peptide
QFFGLM

SEQ ID NO: 596 - protein, 7 aa, Artificial Sequence
  Description of Artificial Sequence: Synthetic Peptide
QQFFGLM

SEQ ID NO: 597 - protein, 6 aa, Artificial Sequence
  Description of Artificial Sequence: Synthetic Peptide
QFFGLM

SEQ ID NO: 598 - protein, 10 aa, Artificial Sequence
  Description of Artificial Sequence: Synthetic Peptide
RPKPQQFFLM

SEQ ID NO: 599 - protein, 10 aa, Artificial Sequence
  Description of Artificial Sequence: Synthetic Peptide
RPKPQQFFGL

SEQ ID NO: 600 - protein, 8 aa, Artificial Sequence
  Description of Artificial Sequence: Synthetic Peptide
PQQFFGLM

SEQ ID NO: 601 - protein, 6 aa, Artificial Sequence
  Description of Artificial Sequence: Synthetic Peptide
EFFGLM

SEQ ID NO: 602 - protein, 6 aa, Artificial Sequence
  Description of Artificial Sequence: Synthetic Peptide
EFFPLM

SEQ ID NO: 603 - protein, 10 aa, Artificial Sequence
  Description of Artificial Sequence: Synthetic Peptide
RPKPQQFFGL

SEQ ID NO: 604 - protein, 5 aa, Artificial Sequence
  Description of Artificial Sequence: Synthetic Peptide
FFGLM

SEQ ID NO: 605 - protein, 11 aa, Artificial Sequence
  Description of Artificial Sequence: Synthetic Peptide
RPKPQQFFPLM

SEQ ID NO: 606 - protein, 5 aa, Artificial Sequence
  Description of Artificial Sequence: Synthetic Peptide
FFPLM

SEQ ID NO: 607 - protein, 7 aa, Artificial Sequence
  Description of Artificial Sequence: Synthetic Peptide
QQFFGLM

SEQ ID NO: 608 - protein, 10 aa, Artificial Sequence
  Description of Artificial Sequence: Synthetic Peptide
RPKPQQFFLM

SEQ ID NO: 609 - protein, 6 aa, Artificial Sequence
  Description of Artificial Sequence: Synthetic Peptide
EFFPLM

SEQ ID NO: 610 - protein, 11 aa, Artificial Sequence
  Description of Artificial Sequence: Synthetic Peptide
RPKPQQWFWLL

SEQ ID NO: 611 - protein, 9 aa, Artificial Sequence
  Description of Artificial Sequence: Synthetic Peptide
KPPFNWFWL

SEQ ID NO: 612 - protein, 11 aa, Artificial Sequence
  Description of Artificial Sequence: Synthetic Peptide
RPKPQQFFGLM

SEQ ID NO: 613 - protein, 11 aa, Artificial Sequence
  Description of Artificial Sequence: Synthetic Peptide
KPRPQQFIGLM

SEQ ID NO: 614 - protein, 11 aa, Artificial Sequence
  Description of Artificial Sequence: Synthetic Peptide
KPRPHQFFGLM

SEQ ID NO: 615 - protein, 3 aa, Artificial Sequence
  Description of Artificial Sequence: Synthetic Peptide
QWF

SEQ ID NO: 616 - protein, 14 aa, Artificial Sequence
  Description of Artificial Sequence: Synthetic Peptide
RPKPQQFFGLMGKR

SEQ ID NO: 617 - protein, 4 aa, Artificial Sequence
  Description of Artificial Sequence: Synthetic Peptide
RPKP

SEQ ID NO: 618 - protein, 6 aa, Artificial Sequence
  Description of Artificial Sequence: Synthetic Peptide
RPKPQQ

SEQ ID NO: 619 - protein, 7 aa, Artificial Sequence
  Description of Artificial Sequence: Synthetic Peptide
RPKPQQF

SEQ ID NO: 620 - protein, 9 aa, Artificial Sequence
  Description of Artificial Sequence: Synthetic Peptide
RPKPQQFFG

SEQ ID NO: 621 - protein, 10 aa, Artificial Sequence
  Description of Artificial Sequence: Synthetic Peptide
PKPQQFFGLM

SEQ ID NO: 622 - protein, 9 aa, Artificial Sequence
  Description of Artificial Sequence: Synthetic Peptide
KPQQFFGLM

SEQ ID NO: 623 - protein, 4 aa, Artificial Sequence
  Description of Artificial Sequence: Synthetic Peptide
FGLM

SEQ ID NO: 624 - protein, 3 aa, Artificial Sequence
  Description of Artificial Sequence: Synthetic Peptide
GLM

SEQ ID NO: 625 - protein, 11 aa, Artificial Sequence
  Description of Artificial Sequence: Synthetic Peptide
RPKPQQFFGLM

SEQ ID NO: 626 - protein, 11 aa, Artificial Sequence
  Description of Artificial Sequence: Synthetic Peptide
RPKPQQFFGLM

SEQ ID NO: 627 - protein, 10 aa, Artificial Sequence
  Description of Artificial Sequence: Synthetic Peptide
RPKPQQFYGL

SEQ ID NO: 628 - protein, 7 aa, Artificial Sequence
  Description of Artificial Sequence: Synthetic Peptide
DRVYIHA

SEQ ID NO: 629 - protein, 11 aa, Artificial Sequence
  Description of Artificial Sequence: Synthetic Peptide
APGDRIYVHPF

SEQ ID NO: 630 - protein, 7 aa, Artificial Sequence
  Description of Artificial Sequence: Synthetic Peptide
GVYVHPV

SEQ ID NO: 631 - protein, 15 aa, Artificial Sequence
  Description of Artificial Sequence: Synthetic Peptide
ENGLPVHLDQSIFRR

SEQ ID NO: 632 - protein, 15 aa, Artificial Sequence
  Description of Artificial Sequence: Synthetic Peptide
ENGLPVHLDQSIFRR

SEQ ID NO: 633 - protein, 10 aa, Artificial Sequence
  Description of Artificial Sequence: Synthetic Peptide
GLPPRPKIPP

SEQ ID NO: 634 - protein, 10 aa, Artificial Sequence
  Description of Artificial Sequence: Synthetic Peptide
GLPPGPPIPP

SEQ ID NO: 635 - protein, 8 aa, Artificial Sequence
  Description of Artificial Sequence: Synthetic Peptide
RPGFSPFR

SEQ ID NO: 636 - protein, 8 aa, Artificial Sequence
  Description of Artificial Sequence: Synthetic Peptide
RPGFSPFR

SEQ ID NO: 637 - protein, 10 aa, Artificial Sequence
  Description of Artificial Sequence: Synthetic Peptide
DRVYIHPFHL

SEQ ID NO: 638 - protein, 3 aa, Artificial Sequence
  Description of Artificial Sequence: Synthetic Peptide
GGG

SEQ ID NO: 639 - protein, 7 aa, Artificial Sequence
  Description of Artificial Sequence: Synthetic Peptide
DRVYIHP

SEQ ID NO: 640 - protein, 7 aa, Artificial Sequence
  Description of Artificial Sequence: Synthetic Peptide
CYWKVCT

SEQ ID NO: 641 - protein, 8 aa, Artificial Sequence
  Description of Artificial Sequence: Synthetic Peptide
DRVYIHPF

SEQ ID NO: 642 - protein, 8 aa, Artificial Sequence
  Description of Artificial Sequence: Synthetic Peptide
EGVYVHPV

SEQ ID NO: 643 - protein, 4 aa, Artificial Sequence
  Description of Artificial Sequence: Synthetic Peptide
DRVY

SEQ ID NO: 644 - protein, 6 aa, Artificial Sequence
  Description of Artificial Sequence: Synthetic Peptide
VYIHPF

SEQ ID NO: 645 - protein, 5 aa, Artificial Sequence
  Description of Artificial Sequence: Synthetic Peptide
YIHPF

SEQ ID NO: 646 - protein, 4 aa, Artificial Sequence
  Description of Artificial Sequence: Synthetic Peptide
IHPF

SEQ ID NO: 647 - protein, 7 aa, Artificial Sequence
  Description of Artificial Sequence: Synthetic Peptide
RVYIHPF

SEQ ID NO: 648 - protein, 7 aa, Artificial Sequence
  Description of Artificial Sequence: Synthetic Peptide
RVYIHPI

SEQ ID NO: 649 - protein, 8 aa, Artificial Sequence
  Description of Artificial Sequence: Synthetic Peptide
PTHIKWGD

SEQ ID NO: 650 - protein, 9 aa, Artificial Sequence
  Description of Artificial Sequence: Synthetic Peptide
EWPRPQIPP

SEQ ID NO: 651 - protein, 10 aa, Artificial Sequence
  Description of Artificial Sequence: Synthetic Peptide
NRVYVHPFHL

SEQ ID NO: 652 - protein, 10 aa, Artificial Sequence
  Description of Artificial Sequence: Synthetic Peptide
NRVYVHPFNL

SEQ ID NO: 653 - protein, 10 aa, Artificial Sequence
  Description of Artificial Sequence: Synthetic Peptide
NRVYVHPFGL

SEQ ID NO: 654 - protein, 7 aa, Artificial Sequence
  Description of Artificial Sequence: Synthetic Peptide
NRVYVHP

SEQ ID NO: 655 - protein, 8 aa, Artificial Sequence
  Description of Artificial Sequence: Synthetic Peptide
NRVYVHPF

SEQ ID NO: 656 - protein, 9 aa, Artificial Sequence
  Description of Artificial Sequence: Synthetic Peptide
RVYIHPFHL

SEQ ID NO: 657 - protein, 6 aa, Artificial Sequence
  Description of Artificial Sequence: Synthetic Peptide
YKRHPI

SEQ ID NO: 658 - protein, 8 aa, Artificial Sequence
  Description of Artificial Sequence: Synthetic Peptide
DRVYIFPF

SEQ ID NO: 659 - protein, 13 aa, Artificial Sequence
  Description of Artificial Sequence: Synthetic Peptide
DRVYIHPFHLVIH

SEQ ID NO: 660 - protein, 14 aa, Artificial Sequence
  Description of Artificial Sequence: Synthetic Peptide
DRVYIHPFHLVIHN

SEQ ID NO: 661 - protein, 14 aa, Artificial Sequence
  Description of Artificial Sequence: Synthetic Peptide
DRVYIHPFHLLVYS

SEQ ID NO: 662 - protein, 7 aa, Artificial Sequence
  Description of Artificial Sequence: Synthetic Peptide
RVYIHPF

SEQ ID NO: 663 - protein, 6 aa, Artificial Sequence
  Description of Artificial Sequence: Synthetic Peptide
RVYIHP

SEQ ID NO: 664 - protein, 7 aa, Artificial Sequence
  Description of Artificial Sequence: Synthetic Peptide
RVYIHPA

SEQ ID NO: 665 - protein, 7 aa, Artificial Sequence
  Description of Artificial Sequence: Synthetic Peptide
RVYIHPI

SEQ ID NO: 666 - protein, 7 aa, Artificial Sequence
  Description of Artificial Sequence: Synthetic Peptide
RVYIHPT

SEQ ID NO: 667 - protein, 7 aa, Artificial Sequence
  Description of Artificial Sequence: Synthetic Peptide
RVYIHPF

SEQ ID NO: 668 - protein, 7 aa, Artificial Sequence
  Description of Artificial Sequence: Synthetic Peptide
RVYVHPA

SEQ ID NO: 669 - protein, 6 aa, Artificial Sequence
  Description of Artificial Sequence: Synthetic Peptide
VYIHPI

SEQ ID NO: 670 - protein, 14 aa, Artificial Sequence
  Description of Artificial Sequence: Synthetic Peptide
DRVYIHPFHLVIHS

SEQ ID NO: 671 - protein, 7 aa, Artificial Sequence
  Description of Artificial Sequence: Synthetic Peptide
RVYVHPF

SEQ ID NO: 672 - protein, 8 aa, Artificial Sequence
  Description of Artificial Sequence: Synthetic Peptide
DRVYVHPF

SEQ ID NO: 673 - protein, 8 aa, Artificial Sequence
  Description of Artificial Sequence: Synthetic Peptide
DRVYVHPF

SEQ ID NO: 674 - protein, 10 aa, Artificial Sequence
  Description of Artificial Sequence: Synthetic Peptide
DRVYVHPFHL

SEQ ID NO: 675 - protein, 10 aa, Artificial Sequence
  Description of Artificial Sequence: Synthetic Peptide
DRVYVHPFNL

SEQ ID NO: 676 - protein, 10 aa, Artificial Sequence
  Description of Artificial Sequence: Synthetic Peptide
DRVYVHPFSL

SEQ ID NO: 677 - protein, 10 aa, Artificial Sequence
  Description of Artificial Sequence: Synthetic Peptide
DRVYVHPFHL

SEQ ID NO: 678 - protein, 14 aa, Artificial Sequence
  Description of Artificial Sequence: Synthetic Peptide
DRVYIHPFHLVIHN

SEQ ID NO: 679 - protein, 14 aa, Artificial Sequence
  Description of Artificial Sequence: Synthetic Peptide
DRVYIHPFHLLVYS

SEQ ID NO: 680 - protein, 10 aa, Artificial Sequence
  Description of Artificial Sequence: Synthetic Peptide
PHPFHFFVYK

SEQ ID NO: 681 - protein, 14 aa, Artificial Sequence
  Description of Artificial Sequence: Synthetic Peptide
DRVYIHPFHLLYYS

SEQ ID NO: 682 - protein, 14 aa, Artificial Sequence
  Description of Artificial Sequence: Synthetic Peptide
DRVYIHPCHLLYYS

SEQ ID NO: 683 - protein, 14 aa, Artificial Sequence
  Description of Artificial Sequence: Synthetic Peptide
DRVYIHPLHLLYYS

SEQ ID NO: 684 - protein, 14 aa, Artificial Sequence
  Description of Artificial Sequence: Synthetic Peptide
DRVYIHPVHLLYYS

SEQ ID NO: 685 - protein, 38 aa, Artificial Sequence
  Description of Artificial Sequence: Synthetic Peptide
CSCSSLMDKECVYFCHLDIIWVNTPEHVVPYGLGSPRS

SEQ ID NO: 686 - protein, 20 aa, Artificial Sequence
  Description of Artificial Sequence: Synthetic Peptide
INTPEQTVPYGLSNYRGSFR

SEQ ID NO: 687 - protein, 18 aa, Artificial Sequence
  Description of Artificial Sequence: Synthetic Peptide
VNTPERVVPYGLGSPSRS

SEQ ID NO: 688 - protein, 39 aa, Artificial Sequence
  Description of Artificial Sequence: Synthetic Peptide
CSCSSLMDKECVYFCHLDIIWVNTPEHVVPYGLGSPSRS

SEQ ID NO: 689 - protein, 18 aa, Artificial Sequence
  Description of Artificial Sequence: Synthetic Peptide
VNTPEHVVPYGLGSPSRS

SEQ ID NO: 690 - protein, 20 aa, Artificial Sequence
  Description of Artificial Sequence: Synthetic Peptide
IIWVNTPEHVVPYGLGSPRS

SEQ ID NO: 691 - protein, 17 aa, Artificial Sequence
  Description of Artificial Sequence: Synthetic Peptide
VNTPEHVVPYGLGSPRS

SEQ ID NO: 692 - protein, 37 aa, Artificial Sequence
  Description of Artificial Sequence: Synthetic Peptide
CSCSSWLDKECVYFCHLDIIWVNTPEQTAPYGLGNPP

SEQ ID NO: 693 - protein, 16 aa, Artificial Sequence
  Description of Artificial Sequence: Synthetic Peptide
VNTPEQTAPYGLGNPP

SEQ ID NO: 694 - protein, 41 aa, Artificial Sequence
  Description of Artificial Sequence: Synthetic Peptide
CTCFTYKDKECVYYCHLDIIWINTPEQTVPYGLSNYRGSFR

SEQ ID NO: 695 - protein, 39 aa, Artificial Sequence
  Description of Artificial Sequence: Synthetic Peptide
CSCSSLMDKECVYFCHLDIIWVNTPEHIVPYGLGSPSRS

SEQ ID NO: 696 - protein, 18 aa, Artificial Sequence
  Description of Artificial Sequence: Synthetic Peptide
VNTPEHVVPYGLGSPSRS

SEQ ID NO: 697 - protein, 39 aa, Artificial Sequence
  Description of Artificial Sequence: Synthetic Peptide
CSCSSLMDKECVYFCHLDIIWVNTPERVVPYGLGSPSRS

SEQ ID NO: 698 - protein, 38 aa, Artificial Sequence
  Description of Artificial Sequence: Synthetic Peptide
CSCSSWLDKECVYFCHLDIIWVNTPEQTAPYGLGNPPR

SEQ ID NO: 699 - protein, 17 aa, Artificial Sequence
  Description of Artificial Sequence: Synthetic Peptide
VNTPEQTAPYGLGNPPR

SEQ ID NO: 700 - protein, 41 aa, Artificial Sequence
  Description of Artificial Sequence: Synthetic Peptide
CTCFTYKDKECVYYCHLDIIWINTPEQTVPYGLSNHRGSLR

SEQ ID NO: 701 - protein, 20 aa, Artificial Sequence
  Description of Artificial Sequence: Synthetic Peptide
CQCASQKDKKWSYCQAGKEI

SEQ ID NO: 702 - protein, 21 aa, Artificial Sequence
  Description of Artificial Sequence: Synthetic Peptide
CSCSSLMDKECVYFCHLDIIW

SEQ ID NO: 703 - protein, 15 aa, Artificial Sequence
  Description of Artificial Sequence: Synthetic Peptide
CSCSSLMDKECVYFC

SEQ ID NO: 704 - protein, 15 aa, Artificial Sequence
  Description of Artificial Sequence: Synthetic Peptide
CSCSSLMDKECVYFC

SEQ ID NO: 705 - protein, 6 aa, Artificial Sequence
  Description of Artificial Sequence: Synthetic Peptide
WLDIIW

SEQ ID NO: 706 - protein, 21 aa, Artificial Sequence
  Description of Artificial Sequence: Synthetic Peptide
CSASSLMDKEAVYFCHLDIIW

SEQ ID NO: 707 - protein, 20 aa, Artificial Sequence
  Description of Artificial Sequence: Synthetic Peptide
SCSSLMDKECVYFDHLDIIW

SEQ ID NO: 708 - protein, 21 aa, Artificial Sequence
  Description of Artificial Sequence: Synthetic Peptide
ASASSLMDKEAVYFAHLDIIW

SEQ ID NO: 709 - protein, 16 aa, Artificial Sequence
  Description of Artificial Sequence: Synthetic Peptide
LMDKEAVYFAHLDIIW

SEQ ID NO: 710 - protein, 21 aa, Artificial Sequence
  Description of Artificial Sequence: Synthetic Peptide
CACFTYKDKECVYYCHLDIIW

SEQ ID NO: 711 - protein, 20 aa, Artificial Sequence
  Description of Artificial Sequence: Synthetic Peptide
CSASSLDKEAVYFCHLAIIW

SEQ ID NO: 712 - protein, 21 aa, Artificial Sequence
  Description of Artificial Sequence: Synthetic Peptide
CSCSSLMDKECVYFCHLNIIW

SEQ ID NO: 713 - protein, 15 aa, Artificial Sequence
  Description of Artificial Sequence: Synthetic Peptide
NWHGTAPDWFFNYYW

SEQ ID NO: 714 - protein, 14 aa, Artificial Sequence
  Description of Artificial Sequence: Synthetic Peptide
DEEAVYFAHLDIIW

SEQ ID NO: 715 - protein, 6 aa, Artificial Sequence
  Description of Artificial Sequence: Synthetic Peptide
HLDIIW

SEQ ID NO: 716 - protein, 23 aa, Artificial Sequence
  Description of Artificial Sequence: Synthetic Peptide
HLDIIWVNTPEHVVPYGLGSPRS

SEQ ID NO: 717 - protein, 21 aa, Artificial Sequence
  Description of Artificial Sequence: Synthetic Peptide
CSCSSWLDKECVYFCHLDIIW

SEQ ID NO: 718 - protein, 21 aa, Artificial Sequence
  Description of Artificial Sequence: Synthetic Peptide
CTCFTYKDKECVYYCHLDIIW

SEQ ID NO: 719 - protein, 16 aa, Artificial Sequence
  Description of Artificial Sequence: Synthetic Peptide
SLKDLFPAKAADRRDR

SEQ ID NO: 720 - protein, 3 aa, Artificial Sequence
  Description of Artificial Sequence: Synthetic Peptide
LWW

SEQ ID NO: 721 - protein, 4 aa, Artificial Sequence
  Description of Artificial Sequence: Synthetic Peptide
MLMW

SEQ ID NO: 722 - protein, 1 aa, Artificial Sequence
  Description of Artificial Sequence: Synthetic Peptide
R

SEQ ID NO: 723 - protein, 5 aa, Artificial Sequence
  Description of Artificial Sequence: Synthetic Peptide
DPILW

SEQ ID NO: 724 - protein, 5 aa, Artificial Sequence
  Description of Artificial Sequence: Synthetic Peptide
SPVLW

SEQ ID NO: 725 - protein, 5 aa, Artificial Sequence
  Description of Artificial Sequence: Synthetic Peptide
LDIIW

SEQ ID NO: 726 - protein, 5 aa, Artificial Sequence
  Description of Artificial Sequence: Synthetic Peptide
LDIIW

SEQ ID NO: 727 - protein, 21 aa, Artificial Sequence
  Description of Artificial Sequence: Synthetic Peptide
CSCKDMTDKECLNFCHQDVIW

SEQ ID NO: 728 - protein, 21 aa, Artificial Sequence
  Description of Artificial Sequence: Synthetic Peptide
CSCKDMTDKECLYFCHQDVIW

SEQ ID NO: 729 - protein, 21 aa, Artificial Sequence
  Description of Artificial Sequence: Synthetic Peptide
CTCNDMTDEECLNFCHQDVIW

SEQ ID NO: 730 - protein, 16 aa, Artificial Sequence
  Description of Artificial Sequence: Synthetic Peptide
GNWHGTAPDWFFNYYW

SEQ ID NO: 731 - protein, 6 aa, Artificial Sequence
  Description of Artificial Sequence: Synthetic Peptide
HLDIIW

SEQ ID NO: 732 - protein, 45 aa, Artificial Sequence
  Description of Artificial Sequence: Synthetic Peptide
TLDEEDLVDSLSEGDAYTNGLQVNFHSPRSGQRCWAARTQVEKRL

SEQ ID NO: 733 - protein, 16 aa, Artificial Sequence
  Description of Artificial Sequence: Synthetic Peptide
CPPGSPMNPHHKCEVW

SEQ ID NO: 734 - protein, 5 aa, Artificial Sequence
  Description of Artificial Sequence: Synthetic Peptide
DPVLW

SEQ ID NO: 735 - protein, 5 aa, Artificial Sequence
  Description of Artificial Sequence: Synthetic Peptide
EAIWL

SEQ ID NO: 736 - protein, 4 aa, Artificial Sequence
  Description of Artificial Sequence: Synthetic Peptide
AVLW

SEQ ID NO: 737 - protein, 3 aa, Artificial Sequence
  Description of Artificial Sequence: Synthetic Peptide
LWW

SEQ ID NO: 738 - protein, 2 aa, Artificial Sequence
  Description of Artificial Sequence: Synthetic Peptide
LW

SEQ ID NO: 739 - protein, 3 aa, Artificial Sequence
  Description of Artificial Sequence: Synthetic Peptide
LWY

SEQ ID NO: 740 - protein, 6 aa, Artificial Sequence
  Description of Artificial Sequence: Synthetic Peptide
LWAAYF

SEQ ID NO: 741 - protein, 16 aa, Artificial Sequence
  Description of Artificial Sequence: Synthetic Peptide
GNWHGTSPDWFFNYYW

SEQ ID NO: 742 - protein, 14 aa, Artificial Sequence
  Description of Artificial Sequence: Synthetic Peptide
DKEAVYFAHLDIIW

SEQ ID NO: 743 - protein, 21 aa, Artificial Sequence
  Description of Artificial Sequence: Synthetic Peptide
CTCKDMTDKECLYFCHQDIIW

SEQ ID NO: 744 - protein, 21 aa, Artificial Sequence
  Description of Artificial Sequence: Synthetic Peptide
CTCKDMTDEECLNFCHQDVIW

SEQ ID NO: 745 - protein, 7 aa, Artificial Sequence
  Description of Artificial Sequence: Synthetic Peptide
YPFVEPI

SEQ ID NO: 746 - protein, 3 aa, Artificial Sequence
  Description of Artificial Sequence: Synthetic Peptide
YPF

SEQ ID NO: 747 - protein, 3 aa, Artificial Sequence
  Description of Artificial Sequence: Synthetic Peptide
YPF

SEQ ID NO: 748 - protein, 7 aa, Artificial Sequence
  Description of Artificial Sequence: Synthetic Peptide
YPFPGPI

SEQ ID NO: 749 - protein, 4 aa, Artificial Sequence
  Description of Artificial Sequence: Synthetic Peptide
YPFP

SEQ ID NO: 750 - protein, 5 aa, Artificial Sequence
  Description of Artificial Sequence: Synthetic Peptide
YPFPG

SEQ ID NO: 751 - protein, 5 aa, Artificial Sequence
  Description of Artificial Sequence: Synthetic Peptide
YPFPG

SEQ ID NO: 752 - protein, 5 aa, Artificial Sequence
  Description of Artificial Sequence: Synthetic Peptide
YPFPG

SEQ ID NO: 753 - protein, 7 aa, Artificial Sequence
  Description of Artificial Sequence: Synthetic Peptide
YPFVEPI

SEQ ID NO: 754 - protein, 2 aa, Artificial Sequence
  Description of Artificial Sequence: Synthetic Peptide
YF

SEQ ID NO: 755 - protein, 3 aa, Artificial Sequence
  Description of Artificial Sequence: Synthetic Peptide
YFY

SEQ ID NO: 756 - protein, 3 aa, Artificial Sequence
  Description of Artificial Sequence: Synthetic Peptide
YFY

SEQ ID NO: 757 - protein, 4 aa, Artificial Sequence
  Description of Artificial Sequence: Synthetic Peptide
YFPY

SEQ ID NO: 758 - protein, 3 aa, Artificial Sequence
  Description of Artificial Sequence: Synthetic Peptide
YFP

SEQ ID NO: 759 - protein, 3 aa, Artificial Sequence
  Description of Artificial Sequence: Synthetic Peptide
YFP

SEQ ID NO: 760 - protein, 3 aa, Artificial Sequence
  Description of Artificial Sequence: Synthetic Peptide
YFP

SEQ ID NO: 761 - protein, 4 aa, Artificial Sequence
  Description of Artificial Sequence: Synthetic Peptide
YFPG

SEQ ID NO: 762 - protein, 4 aa, Artificial Sequence
  Description of Artificial Sequence: Synthetic Peptide
YFPG

SEQ ID NO: 763 - protein, 4 aa, Artificial Sequence
  Description of Artificial Sequence: Synthetic Peptide
YFPG

SEQ ID NO: 764 - protein, 5 aa, Artificial Sequence
  Description of Artificial Sequence: Synthetic Peptide
YFPGP

SEQ ID NO: 765 - protein, 3 aa, Artificial Sequence
  Description of Artificial Sequence: Synthetic Peptide
YFP

SEQ ID NO: 766 - protein, 6 aa, Artificial Sequence
  Description of Artificial Sequence: Synthetic Peptide
PFPGPI

SEQ ID NO: 767 - protein, 6 aa, Artificial Sequence
  Description of Artificial Sequence: Synthetic Peptide
PFPGPI

SEQ ID NO: 768 - protein, 4 aa, Artificial Sequence
  Description of Artificial Sequence: Synthetic Peptide
YPVP

SEQ ID NO: 769 - protein, 4 aa, Artificial Sequence
  Description of Artificial Sequence: Synthetic Peptide
YPFP

SEQ ID NO: 770 - protein, 4 aa, Artificial Sequence
  Description of Artificial Sequence: Synthetic Peptide
YPFP

SEQ ID NO: 771 - protein, 3 aa, Artificial Sequence
  Description of Artificial Sequence: Synthetic Peptide
YPP

SEQ ID NO: 772 - protein, 7 aa, Artificial Sequence
  Description of Artificial Sequence: Synthetic Peptide
YAFGYPS

SEQ ID NO: 773 - protein, 3 aa, Artificial Sequence
  Description of Artificial Sequence: Synthetic Peptide
YRF

SEQ ID NO: 774 - protein, 32 aa, Artificial Sequence
  Description of Artificial Sequence: Synthetic Peptide
YGGFLRRIRPKLKWDNQKRYGGFLRRQFKVVT

SEQ ID NO: 775 - protein, 17 aa, Artificial Sequence
  Description of Artificial Sequence: Synthetic Peptide
YGGFLRRIRPKLKWDNQ

SEQ ID NO: 776 - protein, 11 aa, Artificial Sequence
  Description of Artificial Sequence: Synthetic Peptide
YGFLRIRPKLK

SEQ ID NO: 777 - protein, 17 aa, Artificial Sequence
  Description of Artificial Sequence: Synthetic Peptide
YAGFLRRIRPKLKWDNQ

SEQ ID NO: 778 - protein, 17 aa, Artificial Sequence
  Description of Artificial Sequence: Synthetic Peptide
YAGFLRRIRPKLKWDNQ

SEQ ID NO: 779 - protein, 17 aa, Artificial Sequence
  Description of Artificial Sequence: Synthetic Peptide
YAGFLRRIRPKLKWDNQ

SEQ ID NO: 780 - protein, 12 aa, Artificial Sequence
  Description of Artificial Sequence: Synthetic Peptide
YGFLRRIRPKLK

SEQ ID NO: 781 - protein, 8 aa, Artificial Sequence
  Description of Artificial Sequence: Synthetic Peptide
YGFLRRIR

SEQ ID NO: 782 - protein, 12 aa, Artificial Sequence
  Description of Artificial Sequence: Synthetic Peptide
YGGFLRIRPKLK

SEQ ID NO: 783 - protein, 12 aa, Artificial Sequence
  Description of Artificial Sequence: Synthetic Peptide
YGGFLRRRPKLK

SEQ ID NO: 784 - protein, 7 aa, Artificial Sequence
  Description of Artificial Sequence: Synthetic Peptide
GGFLRRI

SEQ ID NO: 785 - protein, 12 aa, Artificial Sequence
  Description of Artificial Sequence: Synthetic Peptide
YGGFLRRIRPKL

SEQ ID NO: 786 - protein, 13 aa, Artificial Sequence
  Description of Artificial Sequence: Synthetic Peptide
YGGFLRRIRPKLK

SEQ ID NO: 787 - protein, 13 aa, Artificial Sequence
  Description of Artificial Sequence: Synthetic Peptide
YGGFLRRIRPKLK

SEQ ID NO: 788 - protein, 10 aa, Artificial Sequence
  Description of Artificial Sequence: Synthetic Peptide
YGGFLRRIRP

SEQ ID NO: 789 - protein, 14 aa, Artificial Sequence
  Description of Artificial Sequence: Synthetic Peptide
YGGFLRRIRPRLRG

SEQ ID NO: 790 - protein, 16 aa, Artificial Sequence
  Description of Artificial Sequence: Synthetic Peptide
GGFLRRIRPKLKWDNQ

SEQ ID NO: 791 - protein, 16 aa, Artificial Sequence
  Description of Artificial Sequence: Synthetic Peptide
GGFLRRIRPKLKWDNQ

SEQ ID NO: 792 - protein, 11 aa, Artificial Sequence
  Description of Artificial Sequence: Synthetic Peptide
GGFLRRIRPKL

SEQ ID NO: 793 - protein, 15 aa, Artificial Sequence
  Description of Artificial Sequence: Synthetic Peptide
GFLRRIRPKLKWDNQ

SEQ ID NO: 794 - protein, 6 aa, Artificial Sequence
  Description of Artificial Sequence: Synthetic Peptide
GFLRRI

SEQ ID NO: 795 - protein, 11 aa, Artificial Sequence
  Description of Artificial Sequence: Synthetic Peptide
GFLRRIRPKLK

SEQ ID NO: 796 - protein, 15 aa, Artificial Sequence
  Description of Artificial Sequence: Synthetic Peptide
GFLRRIRPKLKWDNQ

SEQ ID NO: 797 - protein, 11 aa, Artificial Sequence
  Description of Artificial Sequence: Synthetic Peptide
RIRPKLKWDNQ

SEQ ID NO: 798 - protein, 10 aa, Artificial Sequence
  Description of Artificial Sequence: Synthetic Peptide
IRPKLKWDNQ

SEQ ID NO: 799 - protein, 12 aa, Artificial Sequence
  Description of Artificial Sequence: Synthetic Peptide
RRIRPKLKWDNQ

SEQ ID NO: 800 - protein, 16 aa, Artificial Sequence
  Description of Artificial Sequence: Synthetic Peptide
YPFPRRIRPKLKWDNQ

SEQ ID NO: 801 - protein, 9 aa, Artificial Sequence
  Description of Artificial Sequence: Synthetic Peptide
RPKLKWDNQ

SEQ ID NO: 802 - protein, 5 aa, Artificial Sequence
  Description of Artificial Sequence: Synthetic Peptide
KWDNQ

SEQ ID NO: 803 - protein, 17 aa, Artificial Sequence
  Description of Artificial Sequence: Synthetic Peptide
YGGFLRRIRPKLKWDNQ

SEQ ID NO: 804 - protein, 13 aa, Artificial Sequence
  Description of Artificial Sequence: Synthetic Peptide
YGGFLRRQFKVVT

SEQ ID NO: 805 - protein, 9 aa, Artificial Sequence
  Description of Artificial Sequence: Synthetic Peptide
YGGFLRRQF

SEQ ID NO: 806 - protein, 29 aa, Artificial Sequence
  Description of Artificial Sequence: Synthetic Peptide
YGGFLRRQFKVVTRSQEDPNAYSGELFDA

SEQ ID NO: 807 - protein, 10 aa, Artificial Sequence
  Description of Artificial Sequence: Synthetic Peptide
YGGFLRKYPK

SEQ ID NO: 808 - protein, 9 aa, Artificial Sequence
  Description of Artificial Sequence: Synthetic Peptide
YGGFLRKYP

SEQ ID NO: 809 - protein, 13 aa, Artificial Sequence
  Description of Artificial Sequence: Synthetic Peptide
YGGFLRRIRPKLK

SEQ ID NO: 810 - protein, 7 aa, Artificial Sequence
  Description of Artificial Sequence: Synthetic Peptide
YGGFLRF

SEQ ID NO: 811 - protein, 7 aa, Artificial Sequence
  Description of Artificial Sequence: Synthetic Peptide
YGGFLRF

SEQ ID NO: 812 - protein, 29 aa, Artificial Sequence
  Description of Artificial Sequence: Synthetic Peptide
YGGFLRRQFKVVTRSQEDPNAYYEELFDV

SEQ ID NO: 813 - protein, 31 aa, Artificial Sequence
  Description of Artificial Sequence: Synthetic Peptide
YGGFMTSEKSQTPLVTLFKNAIIKNAHKKGQ

SEQ ID NO: 814 - protein, 27 aa, Artificial Sequence
  Description of Artificial Sequence: Synthetic Peptide
YGGFMTSEKSQTPLVTLFKNAIIKNAH

SEQ ID NO: 815 - protein, 31 aa, Artificial Sequence
  Description of Artificial Sequence: Synthetic Peptide
YGGFMTSEKSQTPLVTLFKNAIIKNAYKKGE

SEQ ID NO: 816 - protein, 26 aa, Artificial Sequence
  Description of Artificial Sequence: Synthetic Peptide
YGGFMTSEKSQTPLVTLFKNAIIKNA

SEQ ID NO: 817 - protein, 27 aa, Artificial Sequence
  Description of Artificial Sequence: Synthetic Peptide
YGGFMTSEKSQTPLVTLFKNAIIKNAY

SEQ ID NO: 818 - protein, 17 aa, Artificial Sequence
  Description of Artificial Sequence: Synthetic Peptide
YGGFMTSEKSQTPLVTL

SEQ ID NO: 819 - protein, 16 aa, Artificial Sequence
  Description of Artificial Sequence: Synthetic Peptide
YGGFMTSEKSQTPLVT

SEQ ID NO: 820 - protein, 16 aa, Artificial Sequence
  Description of Artificial Sequence: Synthetic Peptide
YGGFMTSEKSQTPLVT

SEQ ID NO: 821 - protein, 11 aa, Artificial Sequence
  Description of Artificial Sequence: Synthetic Peptide
YGGFLRKYRPK

SEQ ID NO: 822 - protein, 7 aa, Artificial Sequence
  Description of Artificial Sequence: Synthetic Peptide
YGGFLRK

SEQ ID NO: 823 - protein, 8 aa, Artificial Sequence
  Description of Artificial Sequence: Synthetic Peptide
YGGFLRKR

SEQ ID NO: 824 - protein, 31 aa, Artificial Sequence; identical to SEQ ID NO: 813
  Description of Artificial Sequence: Synthetic Peptide

SEQ ID NO: 825 - protein, 27 aa, Artificial Sequence
  Description of Artificial Sequence: Synthetic Peptide
YGGFMTSEKSQTPLVTLFKNAIIKNAH

SEQ ID NO: 826 - protein, 31 aa, Artificial Sequence
  Description of Artificial Sequence: Synthetic Peptide
YGGFMSSEKSQTPLVTLFKNAIIKNAHKKGQ

SEQ ID NO: 827 - protein, 31 aa, Artificial Sequence; identical to SEQ ID NO: 815
  Description of Artificial Sequence: Synthetic Peptide

SEQ ID NO: 828 - protein, 21 aa, Artificial Sequence
  Description of Artificial Sequence: Synthetic Peptide
YGGFMTLFKNAIIKNAYKKGE

SEQ ID NO: 829 - protein, 26 aa, Artificial Sequence
  Description of Artificial Sequence: Synthetic Peptide
YGGFMTSEKSQTPLVTLFKNAIIKNA

SEQ ID NO: 830 - protein, 27 aa, Artificial Sequence
  Description of Artificial Sequence: Synthetic Peptide
YGGFMTSEKSQTPLVTLFKNAIIKNAY

SEQ ID NO: 831 - protein, 26 aa, Artificial Sequence
  Description of Artificial Sequence: Synthetic Peptide
TSEKSQTPLVTLFKNAIIKNAYKKGE

SEQ ID NO: 832 - protein, 14 aa, Artificial Sequence
  Description of Artificial Sequence: Synthetic Peptide
FKNAIIKNAYKKGE

SEQ ID NO: 833 - protein, 31 aa, Artificial Sequence
  Description of Artificial Sequence: Synthetic Peptide
YGGFMTSEKSQTPLVTLFKNAIVKNAHKKGQ

SEQ ID NO: 834 - protein, 31 aa, Artificial Sequence
  Description of Artificial Sequence: Synthetic Peptide
YGGFMTSEKSQTPLVTLFKNAIIKNVHKKGQ

SEQ ID NO: 835 - protein, 10 aa, Artificial Sequence
  Description of Artificial Sequence: Synthetic Peptide
ELAGAPPEPA

SEQ ID NO: 836 - protein, 4 aa, Artificial Sequence
  Description of Artificial Sequence: Synthetic Peptide
YGGF

SEQ ID NO: 837 - protein, 9 aa, Artificial Sequence
  Description of Artificial Sequence: Synthetic Peptide
YGGFMTSEK

SEQ ID NO: 838 - protein, 4 aa, Artificial Sequence
  Description of Artificial Sequence: Synthetic Peptide
KKGE

SEQ ID NO: 839 - protein, 31 aa, Artificial Sequence; identical to SEQ ID NO: 815
  Description of Artificial Sequence: Synthetic Peptide

SEQ ID NO: 840 - protein, 17 aa, Artificial Sequence
  Description of Artificial Sequence: Synthetic Peptide
YGGFMTSEKSQTPLVTL

SEQ ID NO: 841 - protein, 1 aa, Artificial Sequence
  Description of Artificial Sequence: Synthetic Peptide
Y

SEQ ID NO: 842 - protein, 8 aa, Artificial Sequence
  Description of Artificial Sequence: Synthetic Peptide
YGFMTSEK

SEQ ID NO: 843 - protein, 8 aa, Artificial Sequence
  Description of Artificial Sequence: Synthetic Peptide
YGFMTSEK

SEQ ID NO: 844 - protein, 16 aa, Artificial Sequence
  Description of Artificial Sequence: Synthetic Peptide
YGFMTSEKSQTPLVTL

SEQ ID NO: 845 - protein, 16 aa, Artificial Sequence
  Description of Artificial Sequence: Synthetic Peptide
GGFMTSEKSQTPLVTL

SEQ ID NO: 846 - protein, 31 aa, Artificial Sequence
  Description of Artificial Sequence: Synthetic Peptide
YGGFLTSEKSQTPLVTLFKNAIIKNAHKKGQ

SEQ ID NO: 847 - protein, 6 aa, Artificial Sequence
  Description of Artificial Sequence: Synthetic Peptide
YGGFMK

SEQ ID NO: 848 - protein, 7 aa, Artificial Sequence
  Description of Artificial Sequence: Synthetic Peptide
YGGFMKK

SEQ ID NO: 849 - protein, 7 aa, Artificial Sequence
  Description of Artificial Sequence: Synthetic Peptide
YGGFMKR

SEQ ID NO: 850 - protein, 8 aa, Artificial Sequence [sequence omitted]

SEQ ID NO: 851 - protein, 8 aa, Artificial Sequence
  Description of Artificial Sequence: Synthetic Peptide
AAAYGGFM

SEQ ID NO: 852 - protein, 26 aa, Artificial Sequence
  Description of Artificial Sequence: Synthetic Peptide
YGGFMKKMDELYPLEVEEEANGGEVL

SEQ ID NO: 853 - protein, 26 aa, Artificial Sequence
  Description of Artificial Sequence: Synthetic Peptide
YGGFMKKMDELYPLEVEEEANGGEVL

SEQ ID NO: 854 - protein, 12 aa, Artificial Sequence
  Description of Artificial Sequence: Synthetic Peptide
YGGFMRRVGRPE

SEQ ID NO: 855 - protein, 12 aa, Artificial Sequence
  Description of Artificial Sequence: Synthetic Peptide
YGGFMRRVGRPE

SEQ ID NO: 856 - protein, 22 aa, Artificial Sequence
  Description of Artificial Sequence: Synthetic Peptide
YGGFMRRVGRPEWWMDYQKRYG

SEQ ID NO: 857 - protein, 3 aa, Artificial Sequence
  Description of Artificial Sequence: Synthetic Peptide
FAR

SEQ ID NO: 858 - protein, 5 aa, Artificial Sequence
  Description of Artificial Sequence: Synthetic Peptide
YAGFG

SEQ ID NO: 859 - protein, 5 aa, Artificial Sequence
  Description of Artificial Sequence: Synthetic Peptide
YAGFL

SEQ ID NO: 860 - protein, 5 aa, Artificial Sequence
  Description of Artificial Sequence: Synthetic Peptide
YAGFM

SEQ ID NO: 861 - protein, 4 aa, Artificial Sequence
  Description of Artificial Sequence: Synthetic Peptide
YGFL

SEQ ID NO: 862 - protein, 5 aa, Artificial Sequence
  Description of Artificial Sequence: Synthetic Peptide
YGFLR

SEQ ID NO: 863 - protein, 2 aa, Artificial Sequence
  Description of Artificial Sequence: Synthetic Peptide
GF

SEQ ID NO: 864 - protein, 2 aa, Artificial Sequence
  Description of Artificial Sequence: Synthetic Peptide
GF

SEQ ID NO: 865 - protein, 4 aa, Artificial Sequence
  Description of Artificial Sequence: Synthetic Peptide
GGFL

SEQ ID NO: 866 - protein, 3 aa, Artificial Sequence
  Description of Artificial Sequence: Synthetic Peptide
YGF

SEQ ID NO: 867 - protein, 3 aa, Artificial Sequence
  Description of Artificial Sequence: Synthetic Peptide
YGF

SEQ ID NO: 868 - protein, 3 aa, Artificial Sequence
  Description of Artificial Sequence: Synthetic Peptide
FLR

SEQ ID NO: 869 - protein, 3 aa, Artificial Sequence
  Description of Artificial Sequence: Synthetic Peptide
YGF

SEQ ID NO: 870 - protein, 5 aa, Artificial Sequence
  Description of Artificial Sequence: Synthetic Peptide
YGGFL

SEQ ID NO: 871 - protein, 5 aa, Artificial Sequence
  Description of Artificial Sequence: Synthetic Peptide
YGGFL

SEQ ID NO: 872 - protein, 5 aa, Artificial Sequence
  Description of Artificial Sequence: Synthetic Peptide
YGGFL

SEQ ID NO: 873 - protein, 5 aa, Artificial Sequence
  Description of Artificial Sequence: Synthetic Peptide
YAGFL

SEQ ID NO: 874 - protein, 6 aa, Artificial Sequence
  Description of Artificial Sequence: Synthetic Peptide
YSGFLT

SEQ ID NO: 875 - protein, 6 aa, Artificial Sequence
  Description of Artificial Sequence: Synthetic Peptide
YTGFLT

SEQ ID NO: 876 - protein, 6 aa, Artificial Sequence
  Description of Artificial Sequence: Synthetic Peptide
YGGFLK

SEQ ID NO: 877 - protein, 6 aa, Artificial Sequence
  Description of Artificial Sequence: Synthetic Peptide
YGGFMR

SEQ ID NO: 878 - protein, 7 aa, Artificial Sequence
  Description of Artificial Sequence: Synthetic Peptide
YGGFMRR

SEQ ID NO: 879 - protein, 9 aa, Artificial Sequence
  Description of Artificial Sequence: Synthetic Peptide
YGGFMRRVG

SEQ ID NO: 880 - protein, 8 aa, Artificial Sequence
  Description of Artificial Sequence: Synthetic Peptide
YGGFMRGL

SEQ ID NO: 881 - protein, 7 aa, Artificial Sequence
  Description of Artificial Sequence: Synthetic Peptide
YGGFMRF

SEQ ID NO: 882 - protein, 5 aa, Artificial Sequence
  Description of Artificial Sequence: Synthetic Peptide
YGGFM

SEQ ID NO: 883 - protein, 5 aa, Artificial Sequence
  Description of Artificial Sequence: Synthetic Peptide
YGGFM

SEQ ID NO: 884 - protein, 5 aa, Artificial Sequence
  Description of Artificial Sequence: Synthetic Peptide
YAGFM

SEQ ID NO: 885 - protein, 5 aa, Artificial Sequence
  Description of Artificial Sequence: Synthetic Peptide
YAGFM

SEQ ID NO: 886 - protein, 7 aa, Artificial Sequence
  Description of Artificial Sequence: Synthetic Peptide
YGGFMRF

SEQ ID NO: 887 - protein, 5 aa, Artificial Sequence
  Description of Artificial Sequence: Synthetic Peptide
YGGFM

SEQ ID NO: 888 - protein, 5 aa, Artificial Sequence
  Description of Artificial Sequence: Synthetic Peptide
YAGFM

SEQ ID NO: 889 - protein, 4 aa, Artificial Sequence
  Description of Artificial Sequence: Synthetic Peptide
YGFP

SEQ ID NO: 890 - protein, 4 aa, Artificial Sequence
  Description of Artificial Sequence: Synthetic Peptide
YGFM

SEQ ID NO: 891 - protein, 8 aa, Artificial Sequence [sequence omitted]

SEQ ID NO: 892 - protein, 31 aa, Artificial Sequence
  Description of Artificial Sequence: Synthetic Peptide
FAEPLPSEEEGESYSKEVPEMEKRYGGFMRF

SEQ ID NO: 893 - protein, 25 aa, Artificial Sequence
  Description of Artificial Sequence: Synthetic Peptide
YGGFMRRVGRPEWWMDYQKRYGGFL

SEQ ID NO: 894 - protein, 34 aa, Artificial Sequence
  Description of Artificial Sequence: Synthetic Peptide
YGGFMKKMDELYPLEVEEEANGGEVLGKRYGGFM

SEQ ID NO: 895 - protein, 19 aa, Artificial Sequence
  Description of Artificial Sequence: Synthetic Peptide
SSEVAGEGDGDSMGHEDLY

SEQ ID NO: 896 - protein, 6 aa, Artificial Sequence
  Description of Artificial Sequence: Synthetic Peptide
LVVYPW

SEQ ID NO: 897 - protein, 2 aa, Artificial Sequence
  Description of Artificial Sequence: Synthetic Peptide
PG

SEQ ID NO: 898 - protein, 4 aa, Artificial Sequence
  Description of Artificial Sequence: Synthetic Peptide
YPFP

SEQ ID NO: 899 - protein, 5 aa, Artificial Sequence
  Description of Artificial Sequence: Synthetic Peptide
YPFPP

SEQ ID NO: 900 - protein, 4 aa, Artificial Sequence
  Description of Artificial Sequence: Synthetic Peptide
YPPP

SEQ ID NO: 901 - protein, 6 aa, Artificial Sequence
  Description of Artificial Sequence: Synthetic Peptide
RYLGYL

SEQ ID NO: 902 - protein, 8 aa, Artificial Sequence
  Description of Artificial Sequence: Synthetic Peptide
AAAYGGFL

SEQ ID NO: 903 - protein, 8 aa, Artificial Sequence
  Description of Artificial Sequence: Synthetic Peptide
AAAYGGFL

SEQ ID NO: 904 - protein, 18 aa, Artificial Sequence
  Description of Artificial Sequence: Synthetic Peptide
YGGFMRRVGRPEWWMDYQ

SEQ ID NO: 905 - protein, 6 aa, Artificial Sequence
  Description of Artificial Sequence: Synthetic Peptide
YPFPPL

SEQ ID NO: 906 - protein, 7 aa, Artificial Sequence
  Description of Artificial Sequence: Synthetic Peptide
YVPFPPF

SEQ ID NO: 907 - protein, 2 aa, Artificial Sequence
  Description of Artificial Sequence: Synthetic Peptide
WG

SEQ ID NO: 908 - protein, 4 aa, Artificial Sequence
  Description of Artificial Sequence: Synthetic Peptide
YRFK

SEQ ID NO: 909 - protein, 7 aa, Artificial Sequence
  Description of Artificial Sequence: Synthetic Peptide
YMFHLMD

SEQ ID NO: 910 - protein, 7 aa, Artificial Sequence
  Description of Artificial Sequence: Synthetic Peptide
YAFDVVG

SEQ ID NO: 911 - protein, 7 aa, Artificial Sequence
  Description of Artificial Sequence: Synthetic Peptide
YAFEVVG

SEQ ID NO: 912 - protein, 4 aa, Artificial Sequence
  Description of Artificial Sequence: Synthetic Peptide
YPWF

SEQ ID NO: 913 - protein, 5 aa, Artificial Sequence
  Description of Artificial Sequence: Synthetic Peptide
YPWFF

SEQ ID NO: 914 - protein, 2 aa, Artificial Sequence
  Description of Artificial Sequence: Synthetic Peptide
YR

SEQ ID NO: 915 - protein, 1 aa, Artificial Sequence
  Description of Artificial Sequence: Synthetic Peptide
Y

SEQ ID NO: 916 - protein, 2 aa, Artificial Sequence
  Description of Artificial Sequence: Synthetic Peptide
LG

SEQ ID NO: 917 - protein, 4 aa, Artificial Sequence
  Description of Artificial Sequence: Synthetic Peptide
PQRF

SEQ ID NO: 918 - protein, 18 aa, Artificial Sequence
  Description of Artificial Sequence: Synthetic Peptide
AGEGLSSPFWSLAAPQRF

SEQ ID NO: 919 - protein, 17 aa, Artificial Sequence
  Description of Artificial Sequence: Synthetic Peptide
FGGFTGARKSARKLANQ

SEQ ID NO: 920 - protein, 3 aa, Artificial Sequence
  Description of Artificial Sequence: Synthetic Peptide
YFF

SEQ ID NO: 921 - protein, 4 aa, Artificial Sequence
  Description of Artificial Sequence: Synthetic Peptide
YPLG

SEQ ID NO: 922 - protein, 4 aa, Artificial Sequence
  Description of Artificial Sequence: Synthetic Peptide
YPWG

SEQ ID NO: 923 - protein, 7 aa, Artificial Sequence
  Description of Artificial Sequence: Synthetic Peptide
VVYPWTQ

SEQ ID NO: 924 - protein, 9 aa, Artificial Sequence
  Description of Artificial Sequence: Synthetic Peptide
LVVYPWTQR

SEQ ID NO: 925 - protein, 2 aa, Artificial Sequence
  Description of Artificial Sequence: Synthetic Peptide
PL

SEQ ID NO: 926 - protein, 17 aa, Artificial Sequence
  Description of Artificial Sequence: Synthetic Peptide
FGGFTGARKSARKLANQ

SEQ ID NO: 927 - protein, 8 aa, Artificial Sequence [sequence omitted]

SEQ ID NO: 928 - protein, 8 aa, Artificial Sequence
  Description of Artificial Sequence: Synthetic Peptide
AKSQGGSN

SEQ ID NO: 929 - protein, 8 aa, Artificial Sequence
  Description of Artificial Sequence: Synthetic Peptide
LEDGPKFL

SEQ ID NO: 930 - protein, 5 aa, Artificial Sequence
  Description of Artificial Sequence: Synthetic Peptide
RKDVY

SEQ ID NO: 931 - protein, 13 aa, Artificial Sequence
  Description of Artificial Sequence: Synthetic Peptide
GEQRKDVYVQLYL

SEQ ID NO: 932 - protein, 28 aa, Artificial Sequence
  Description of Artificial Sequence: Synthetic Peptide
SDAAVDTSSEITTKDLKEKKEVVEEAEN

SEQ ID NO: 933 - protein, 10 aa, Artificial Sequence
  Description of Artificial Sequence: Synthetic Peptide
YQAKSQGGSN

SEQ ID NO: 934 - protein, 28 aa, Artificial Sequence
  Description of Artificial Sequence: Synthetic Peptide
SDAAVDTSSEITTKDLKEKKEVVEEAEN

SEQ ID NO: 935 - protein, 52 aa, Artificial Sequence
  Description of Artificial Sequence: Synthetic Peptide
YRQSMNNFQGLRSFGCRFGTCTVQKLAHQIYQFTDKDKDNVAPRSKISPQGY

SEQ ID NO: 936 - protein, 12 aa, Artificial Sequence
  Description of Artificial Sequence: Synthetic Peptide
YRQSMNNFQGLR

SEQ ID NO: 937 - protein, 37 aa, Artificial Sequence
  Description of Artificial Sequence: Synthetic Peptide
SFGCRFGTCTVQKLAHQIYFTDKDNVAPRSKISPQGY

SEQ ID NO: 938 - protein, 31 aa, Artificial Sequence
  Description of Artificial Sequence: Synthetic Peptide
TVQKLAHQIYQFTDKDKDNVAPRSKISPQGY

SEQ ID NO: 939 - protein, 48 aa, Artificial Sequence
  Description of Artificial Sequence: Synthetic Peptide
ELRMSSSYPTGLADVKAGPAQTLIRPQDMKGASRSPEDSSPDAARIRV

SEQ ID NO: 940 - protein, 33 aa, Artificial Sequence
  Description of Artificial Sequence: Synthetic Peptide
SLPEAGPGRTLVSSKPQAHGAPAPPSGSAPHFL

SEQ ID NO: 941 - protein, 52 aa, Artificial Sequence
  Description of Artificial Sequence: Synthetic Peptide
YRQSMNFQGLRSFGCRFGTCTVQKLAHQIYQFTDKDGVAPRSKISKISPQGY

SEQ ID NO: 942 - protein, 20 aa, Artificial Sequence
  Description of Artificial Sequence: Synthetic Peptide
ARLDVAAEFRKKWNKWALSR

SEQ ID NO: 943 - protein, 53 aa, Artificial Sequence
  Description of Artificial Sequence: Synthetic Peptide
YRQSMNQGSRSTGCRFGTCTMQKLAHQIYQIYQFTDKDKDGMAPRNKISPQGY

SEQ ID NO: 944 - protein, 40 aa, Artificial Sequence
  Description of Artificial Sequence: Synthetic Peptide
STGCRFGTCTMQKLAHQIYQFTDKDKDGMAPRNKISPQGY

SEQ ID NO: 945 - protein, 20 aa, Artificial Sequence
  Description of Artificial Sequence: Synthetic Peptide
ARLDTSSQFRKKWNKWALSR

SEQ ID NO: 946 - protein, 13 aa, Artificial Sequence
  Description of Artificial Sequence: Synthetic Peptide
APSGAQRLYGFGL

SEQ ID NO: 947 - protein, 10 aa, Artificial Sequence
  Description of Artificial Sequence: Synthetic Peptide
GDGRLYAFGL

SEQ ID NO: 948 - protein, 9 aa, Artificial Sequence
  Description of Artificial Sequence: Synthetic Peptide
GGSLYSFGL

SEQ ID NO: 949 - protein, 8 aa, Artificial Sequence
  Description of Artificial Sequence: Synthetic Peptide
DRLYSFGL

SEQ ID NO: 950 - protein, 17 aa, Artificial Sequence
  Description of Artificial Sequence: Synthetic Peptide
VHHQKLVFFAEDVGSNK

SEQ ID NO: 951 - protein, 11 aa, Artificial Sequence
  Description of Artificial Sequence: Synthetic Peptide
GSNKGAIIGLM

SEQ ID NO: 952 - protein, 5 aa, Artificial Sequence
  Description of Artificial Sequence: Synthetic Peptide
RERMS

SEQ ID NO: 953 - protein, 17 aa, Artificial Sequence
  Description of Artificial Sequence: Synthetic Peptide
AKERLEAKHRERMSQVM

SEQ ID NO: 954 - protein, 43 aa, Artificial Sequence
  Description of Artificial Sequence: Synthetic Peptide
DAEFRHDSGYEVHHQKLVFFAEDVGSNKGAIIGLMVGGVVIAT

SEQ ID NO: 955 - protein, 42 aa, Artificial Sequence [sequence omitted]

SEQ ID NO: 956 - protein, 40 aa, Artificial Sequence
  Description of Artificial Sequence: Synthetic Peptide
DAEFRHDSGYEVHHQKLVFFAEDVGSNKGAIIGLMVGGVV

SEQ ID NO: 957 - protein, 11 aa, Artificial Sequence
  Description of Artificial Sequence: Synthetic Peptide
YEVHHQKLVFF

SEQ ID NO: 958 - protein, 14 aa, Artificial Sequence
  Description of Artificial Sequence: Synthetic Peptide
EDVGSNKGAIIGLM

SEQ ID NO: 959 - protein, 28 aa, Artificial Sequence
  Description of Artificial Sequence: Synthetic Peptide
DAEFRHDSGYEVHHQKLVFFAEDVGSNK

SEQ ID NO: 960 - protein, 40 aa, Artificial Sequence
  Description of Artificial Sequence: Synthetic Peptide
VVGGVMLGIIAGKNSGVDEAFFVLKQHHVEYGSDHRFEAD

SEQ ID NO: 961 - protein, 42 aa, Artificial Sequence
  Description of Artificial Sequence: Synthetic Peptide
DAEFGHDSGFEVRHQKLVFFAEDVGSNKGAIIGLMVGGVVIA

SEQ ID NO: 962 - protein, 40 aa, Artificial Sequence
  Description of Artificial Sequence: Synthetic Peptide
DAEFGHDSGFEVRHQKLVFFAEDVGSNKGAIIGLMVGGVV

SEQ ID NO: 963 - protein, 11 aa, Artificial Sequence
  Description of Artificial Sequence: Synthetic Peptide
YEVHHQKLVFF

SEQ ID NO: 964 - protein, 14 aa, Artificial Sequence
  Description of Artificial Sequence: Synthetic Peptide
EDVGSNKGAIIGLM

SEQ ID NO: 965 - protein, 28 aa, Artificial Sequence
  Description of Artificial Sequence: Synthetic Peptide
DAEFRHDSGYEVHHQKLVFFAEDVGSNK

SEQ ID NO: 966 - protein, 40 aa, Artificial Sequence; identical to SEQ ID NO: 960
  Description of Artificial Sequence: Synthetic Peptide

SEQ ID NO: 967 - protein, 42 aa, Artificial Sequence; identical to SEQ ID NO: 961
  Description of Artificial Sequence: Synthetic Peptide

SEQ ID NO: 968 - protein, 40 aa, Artificial Sequence; identical to SEQ ID NO: 962
  Description of Artificial Sequence: Synthetic Peptide

SEQ ID NO: 969 - protein, 11 aa, Artificial Sequence
  Description of Artificial Sequence: Synthetic Peptide
DAEFRHDSGYE

SEQ ID NO: 970 - protein, 5 aa, Artificial Sequence
  Description of Artificial Sequence: Synthetic Peptide
IIGLM

SEQ ID NO: 971 - protein, 4 aa, Artificial Sequence
  Description of Artificial Sequence: Synthetic Peptide
IGLM

SEQ ID NO: 972 - protein, 11 aa, Artificial Sequence
  Description of Artificial Sequence: Synthetic Peptide
MLGIIAGKNSG

SEQ ID NO: 973 - protein, 15 aa, Artificial Sequence
  Description of Artificial Sequence: Synthetic Peptide
NWCKRGRKQCKTHPH

SEQ ID NO: 974 - protein, 20 aa, Artificial Sequence
  Description of Artificial Sequence: Synthetic Peptide
HHGVVEVDAAVTPEERHLSK

SEQ ID NO: 975 - protein, 38 aa, Artificial Sequence
  Description of Artificial Sequence: Synthetic Peptide
DAEFRHDSGYEVHHQKLVFFAEDVGSNKGAIIGLMVGG

SEQ ID NO: 976 - protein, 28 aa, Artificial Sequence
  Description of Artificial Sequence: Synthetic Peptide
DAEFRHDSGYQVHHQKLVFFAEDVGSNK

SEQ ID NO: 977 - protein, 16 aa, Artificial Sequence
  Description of Artificial Sequence: Synthetic Peptide
DAEFRHDSGYQVHHQK

SEQ ID NO: 978 - protein, 40 aa, Artificial Sequence; identical to SEQ ID NO: 956
  Description of Artificial Sequence: Synthetic Peptide

SEQ ID NO: 979 - protein, 35 aa, Artificial Sequence
  Description of Artificial Sequence: Synthetic Peptide
HDSGYEVHHQKLVFFAQDVGSNKGAIIGLMVGGVV

SEQ ID NO: 980 - protein, 35 aa, Artificial Sequence
  Description of Artificial Sequence: Synthetic Peptide
EQVTNVGGAVVTGVTAVAQKTVEGAGSIAAATGFV

SEQ ID NO: 981 - protein, 24 aa, Artificial Sequence
  Description of Artificial Sequence: Synthetic Peptide
LVFFAEDVGSNKGAIIGLMVGGVV

SEQ ID NO: 982 - protein, 11 aa, Artificial Sequence
  Description of Artificial Sequence: Synthetic Peptide
GYVIIKPLVWV

SEQ ID NO: 983 - protein, 17 aa, Artificial Sequence
  Description of Artificial Sequence: Synthetic Peptide
VHHQKLVFFAEDVGSNK

SEQ ID NO: 984 - protein, 11 aa, Artificial Sequence
  Description of Artificial Sequence: Synthetic Peptide
GSNKGAIIGLM

SEQ ID NO: 985 - protein, 5 aa, Artificial Sequence
  Description of Artificial Sequence: Synthetic Peptide
RERMS

SEQ ID NO: 986 - protein, 17 aa, Artificial Sequence
  Description of Artificial Sequence: Synthetic Peptide
AKERLEAKHRERMSQVM

SEQ ID NO: 987 - protein, 43 aa, Artificial Sequence; identical to SEQ ID NO: 954
  Description of Artificial Sequence: Synthetic Peptide

SEQ ID NO: 988 - protein, 42 aa, Artificial Sequence [sequence omitted]

SEQ ID NO: 989 - protein, 40 aa, Artificial Sequence; identical to SEQ ID NO: 956
  Description of Artificial Sequence: Synthetic Peptide

SEQ ID NO: 990 - protein, 11 aa, Artificial Sequence
  Description of Artificial Sequence: Synthetic Peptide
YEVHHQKLVFF

SEQ ID NO: 991 - protein, 14 aa, Artificial Sequence
  Description of Artificial Sequence: Synthetic Peptide
EDVGSNKGAIIGLM

SEQ ID NO: 992 - protein, 28 aa, Artificial Sequence
  Description of Artificial Sequence: Synthetic Peptide
DAEFRHDSGYEVHHQKLVFFAEDVGSNK

SEQ ID NO: 993 - protein, 40 aa, Artificial Sequence; identical to SEQ ID NO: 960
  Description of Artificial Sequence: Synthetic Peptide

SEQ ID NO: 994 - protein, 42 aa, Artificial Sequence; identical to SEQ ID NO: 961
  Description of Artificial Sequence: Synthetic Peptide

SEQ ID NO: 995 - protein, 40 aa, Artificial Sequence; identical to SEQ ID NO: 962
  Description of Artificial Sequence: Synthetic Peptide

SEQ ID NO: 996 - protein, 11 aa, Artificial Sequence
  Description of Artificial Sequence: Synthetic Peptide
DAEFRHDSGYE

SEQ ID NO: 997 - protein, 5 aa, Artificial Sequence
  Description of Artificial Sequence: Synthetic Peptide
IIGLM

SEQ ID NO: 998 - protein, 4 aa, Artificial Sequence
  Description of Artificial Sequence: Synthetic Peptide
IGLM

SEQ ID NO: 999 - protein, 11 aa, Artificial Sequence
  Description of Artificial Sequence: Synthetic Peptide
MLGIIAGKNSG

SEQ ID NO: 1000 - protein, 15 aa, Artificial Sequence
  Description of Artificial Sequence: Synthetic Peptide
NWCKRGRKQCKTHPH

SEQ ID NO: 1001 - protein, 20 aa, Artificial Sequence
  Description of Artificial Sequence: Synthetic Peptide
HHGVVEVDAAVTPEERHLSK

SEQ ID NO: 1002 - protein, 38 aa, Artificial Sequence; identical to SEQ ID NO: 975
  Description of Artificial Sequence: Synthetic Peptide

SEQ ID NO: 1003 - protein, 28 aa, Artificial Sequence
  Description of Artificial Sequence: Synthetic Peptide
DAEFRHDSGYQVHHQKLVFFAEDVGSNK

SEQ ID NO: 1004 - protein, 16 aa, Artificial Sequence
  Description of Artificial Sequence: Synthetic Peptide
DAEFRHDSGYQVHHQK

SEQ ID NO: 1005 - protein, 40 aa, Artificial Sequence; identical to SEQ ID NO: 956
  Description of Artificial Sequence: Synthetic Peptide

SEQ ID NO: 1006 - protein, 35 aa, Artificial Sequence; identical to SEQ ID NO: 979
  Description of Artificial Sequence: Synthetic Peptide

SEQ ID NO: 1007 - protein, 35 aa, Artificial Sequence; identical to SEQ ID NO: 980
  Description of Artificial Sequence: Synthetic Peptide

SEQ ID NO: 1008 - protein, 24 aa, Artificial Sequence
  Description of Artificial Sequence: Synthetic Peptide
LVFFAEDVGSNKGAIIGLMVGGVV

SEQ ID NO: 1009 - protein, 11 aa, Artificial Sequence
  Description of Artificial Sequence: Synthetic Peptide
GYVIIKPLVWV

SEQ ID NO: 1010 - protein, 63 aa, Artificial Sequence
  Description of Artificial Sequence: Synthetic Peptide
RLEKRDVKAVCSQEAMTGPCRAVMPRWYFDLSKGKCVRFIYGGCGGNRNNFESEDYCMAVCKA

SEQ ID NO: 1011 - protein, 39 aa, Artificial Sequence
  Description of Artificial Sequence: Synthetic Peptide
NSSCGEGNHLPTTPCYLQWGTHREFLRRFSIWNHGHLHM

SEQ ID NO: 1012 - protein, 39 aa, Artificial Sequence
  Description of Artificial Sequence: Synthetic Peptide
AGRGKQGGKVRAKAKTRSSRAGLQFPVGRVHRLLRKGNY

SEQ ID NO: 1013 - protein, 21 aa, Artificial Sequence
  Description of Artificial Sequence: Synthetic Peptide
TRSSRAGLQFPVGRVHRLLRK

SEQ ID NO: 1014 - protein, 37 aa, Artificial Sequence
  Description of Artificial Sequence: Synthetic Peptide
KWKLFKKIEKVGQNIRDGIIKAGPAVAVVGQATQIAK

SEQ ID NO: 1015 - protein, 32 aa, Artificial Sequence
  Description of Artificial Sequence: Synthetic Peptide
SWLSKTAKKLENSAKKRISEGIAIAIQGGPRC

SEQ ID NO: 1016 - protein, 31 aa, Artificial Sequence
  Description of Artificial Sequence: Synthetic Peptide
GIMSIVKDVAKNAAKGALSTLSTLSCKLAKT

SEQ ID NO: 1017 - protein, 24 aa, Artificial Sequence
  Description of Artificial Sequence: Synthetic Peptide
FLGALFKVASKVLPSVKCAITKKC

SEQ ID NO: 1018 - protein, 13 aa, Artificial Sequence
  Description of Artificial Sequence: Synthetic Peptide
ILPWKWPWWPWRR

SEQ ID NO: 1019 - protein, 18 aa, Artificial Sequence
  Description of Artificial Sequence: Synthetic Peptide
RGGRLCYCRRRFCVCVGR

SEQ ID NO: 1020 - protein, 18 aa, Artificial Sequence
  Description of Artificial Sequence: Synthetic Peptide
RRWCYRKCYKGYCYRKCR

SEQ ID NO: 1021 - protein, 35 aa, Artificial Sequence
  Description of Artificial Sequence: Synthetic Peptide
RWKIFKKIEKVGQNIRDGIVKAGPAVAVVGQAATI

SEQ ID NO: 1022 - protein, 12 aa, Artificial Sequence
  Description of Artificial Sequence: Synthetic Peptide
RLCRIVVIRVCR

SEQ ID NO: 1023 - protein, 21 aa, Artificial Sequence
  Description of Artificial Sequence: Synthetic Peptide
TRSSRAGLQFPVGRVHRLLRK

SEQ ID NO: 1024 - protein, 14 aa, Artificial Sequence
  Description of Artificial Sequence: Synthetic Peptide
YPPGPLAPPQPFGP

SEQ ID NO: 1025 - protein, 22 aa, Artificial Sequence [sequence omitted]

SEQ ID NO: 1026 - protein, 15 aa, Artificial Sequence
  Description of Artificial Sequence: Synthetic Peptide
ADVLTTGAGNPVGDK

SEQ ID NO: 1027 - protein, 42 aa, Artificial Sequence
  Description of Artificial Sequence: Synthetic Peptide
MAAVSMSVALRQALWGRRVATVAAVSVSKVSTRSLSTSTWRL

SEQ ID NO: 1028 - protein, 23 aa, Artificial Sequence
  Description of Artificial Sequence: Synthetic Peptide
GIGKFKHSAGKFGKAFVGEIMKS

SEQ ID NO: 1029 - protein, 29 aa, Artificial Sequence
  Description of Artificial Sequence: Synthetic Peptide
LRDLVSYCRARGKGRERMNGTRKGHLLYM

SEQ ID NO: 1030 - protein, 4 aa, Artificial Sequence
  Description of Artificial Sequence: Synthetic Peptide
SQNY

SEQ ID NO: 1031 - protein, 12 aa, Artificial Sequence
  Description of Artificial Sequence: Synthetic Peptide
RLCRIVVIRVCR

SEQ ID NO: 1032 - protein, 25 aa, Artificial Sequence
  Description of Artificial Sequence: Synthetic Peptide
NQGRHFCGGALIHARFVMTAASCFQ

SEQ ID NO: 1033 - protein, 2 aa, Artificial Sequence
  Description of Artificial Sequence: Synthetic Peptide
PF

SEQ ID NO: 1034 - protein, 18 aa, Artificial Sequence
  Description of Artificial Sequence: Synthetic Peptide
CNLAVAAASHIYQNQFVQ

SEQ ID NO: 1035 - protein, 19 aa, Artificial Sequence
  Description of Artificial Sequence: Synthetic Peptide
YRVRFLAKENVTQDAEDNC

SEQ ID NO: 1036 - protein, 15 aa, Artificial Sequence
  Description of Artificial Sequence: Synthetic Peptide
KWKLFKKIGAVLKVL

SEQ ID NO: 1037 - protein, 35 aa, Artificial Sequence
  Description of Artificial Sequence: Synthetic Peptide
KWKVFKKIEKMGRNIRNGIVKAGPAIAVLGEAKAL

SEQ ID NO: 1038 - protein, 12 aa, Artificial Sequence
  Description of Artificial Sequence: Synthetic Peptide
TYICEVEDQKEE

SEQ ID NO: 1039 - protein, 29 aa, Artificial Sequence
  Description of Artificial Sequence: Synthetic Peptide
CYCRIPACIAGERRYGTCIYQGRLWAFCC

SEQ ID NO: 1040 - protein, 34 aa, Artificial Sequence
  Description of Artificial Sequence: Synthetic Peptide
ALWKTMLKKLGTMALHAGKAALGAAADTISQGTQ

SEQ ID NO: 1041 - protein, 24 aa, Artificial Sequence
  Description of Artificial Sequence: Synthetic Peptide
GVLSNVIGYLKKLGTGALNAVLKQ

SEQ ID NO: 1042 - protein, 6 aa, Artificial Sequence
  Description of Artificial Sequence: Synthetic Peptide
VEPIPY

SEQ ID NO: 1043 - protein, 11 aa, Artificial Sequence
  Description of Artificial Sequence: Synthetic Peptide
RRWQWRMKKLG

SEQ ID NO: 1044 - protein, 21 aa, Artificial Sequence
  Description of Artificial Sequence: Synthetic Peptide
DAEAVGPEAFADQDLDEREVR

SEQ ID NO: 1045 - protein, 7 aa, Artificial Sequence
  Description of Artificial Sequence: Synthetic Peptide
SIGSLAK

SEQ ID NO: 1046 - protein, 23 aa, Artificial Sequence
  Description of Artificial Sequence: Synthetic Peptide
GIGKFLHSAGKFGKAFVGEIMKS

SEQ ID NO: 1047 - protein, 23 aa, Artificial Sequence
  Description of Artificial Sequence: Synthetic Peptide
GIGKFLHSAKKFGKAFVGEIMNS

SEQ ID NO: 1048 - protein, 27 aa, Artificial Sequence
  Description of Artificial Sequence: Synthetic Peptide
YLVLFFYPLDFTFVCPTEIICPTEIIG

SEQ ID NO: 1049 - protein, 15 aa, Artificial Sequence [sequence omitted]

SEQ ID NO: 1050 - protein, 19 aa, Artificial Sequence [sequence omitted]

SEQ ID NO: 1051 - protein, 4 aa, Artificial Sequence
  Description of Artificial Sequence: Synthetic Peptide
DEVD

SEQ ID NO: 1052 - protein, 4 aa, Artificial Sequence
  Description of Artificial Sequence: Synthetic Peptide
DEVD

SEQ ID NO: 1053 - protein, 3 aa, Artificial Sequence
  Description of Artificial Sequence: Synthetic Peptide
VAD

SEQ ID NO: 1054 - protein, 3 aa, Artificial Sequence
  Description of Artificial Sequence: Synthetic Peptide
VAD

SEQ ID NO: 1055 - protein, 27 aa, Artificial Sequence
  Description of Artificial Sequence: Synthetic Peptide
DPMSSTYIEELGKREVTIPPKYRELLA

SEQ ID NO: 1056 - protein, 4 aa, Artificial Sequence
  Description of Artificial Sequence: Synthetic Peptide
VADM

SEQ ID NO: 1057 - protein, 4 aa, Artificial Sequence
  Description of Artificial Sequence: Synthetic Peptide
DEVD

SEQ ID NO: 1058 - protein, 20 aa, Artificial Sequence
  Description of Artificial Sequence: Synthetic Peptide
AAVALLPAVLLALLAPYVAD

SEQ ID NO: 1059 - protein, 7 aa, Artificial Sequence
  Description of Artificial Sequence: Synthetic Peptide
YVADAPK

SEQ ID NO: 1060 - protein, 20 aa, Artificial Sequence
  Description of Artificial Sequence: Synthetic Peptide
AAVALLPAVLLALLAPDEVD

SEQ ID NO: 1061 - protein, 4 aa, Artificial Sequence
  Description of Artificial Sequence: Synthetic Peptide
YVAD

SEQ ID NO: 1062 - protein, 4 aa, Artificial Sequence
  Description of Artificial Sequence: Synthetic Peptide
YVAD

SEQ ID NO: 1063 - protein, 4 aa, Artificial Sequence
  Description of Artificial Sequence: Synthetic Peptide
YVAD

SEQ ID NO: 1064 - protein, 2 aa, Artificial Sequence
  Description of Artificial Sequence: Synthetic Peptide
VF

SEQ ID NO: 1065 - protein, 3 aa, Artificial Sequence
  Description of Artificial Sequence: Synthetic Peptide
LLL

SEQ ID NO: 1066 - protein, 4 aa, Artificial Sequence
  Description of Artificial Sequence: Synthetic Peptide
YVAD

SEQ ID NO: 1067 - protein, 4 aa, Artificial Sequence
  Description of Artificial Sequence: Synthetic Peptide
VEID

SEQ ID NO: 1068 - protein, 1 aa, Artificial Sequence
  Description of Artificial Sequence: Synthetic Peptide
D

SEQ ID NO: 1069 - protein, 7 aa, Artificial Sequence
  Description of Artificial Sequence: Synthetic Peptide
DEVDAPK

SEQ ID NO: 1070 - protein, 21 aa, Artificial Sequence [sequence omitted]

SEQ ID NO: 1071 - protein, 8 aa, Artificial Sequence
  Description of Artificial Sequence: Synthetic Peptide
ANRLFGEK

SEQ ID NO: 1072 - protein, 19 aa, Artificial Sequence
  Description of Artificial Sequence: Synthetic Peptide
GGGGDIHQGFQSLLTEVNK

SEQ ID NO: 1073 - protein, 14 aa, Artificial Sequence
  Description of Artificial Sequence: Synthetic Peptide
GNTAAQMAQILSFN

SEQ ID NO: 1074 - protein, 25 aa, Artificial Sequence [sequence omitted]

SEQ ID NO: 1075 - protein, 35 aa, Artificial Sequence
  Description of Artificial Sequence: Synthetic Peptide
TGHGGPQFVADHPFLFLIMHKITNCILFFGRFSSP

SEQ ID NO: 1076 - protein, 9 aa, Artificial Sequence
  Description of Artificial Sequence: Synthetic Peptide
APRLRFYSL

SEQ ID NO: 1077 - protein, 8 aa, Artificial Sequence
  Description of Artificial Sequence: Synthetic Peptide
APRLRFYS

SEQ ID NO: 1078 - protein, 7 aa, Artificial Sequence
  Description of Artificial Sequence: Synthetic Peptide
APRLRFY

SEQ ID NO: 1079 - protein, 5 aa, Artificial Sequence
  Description of Artificial Sequence: Synthetic Peptide
RLRFH

SEQ ID NO: 1080 - protein, 5 aa, Artificial Sequence
  Description of Artificial Sequence: Synthetic Peptide
RLRFD

SEQ ID NO: 1081 - protein, 23 aa, Artificial Sequence
  Description of Artificial Sequence: Synthetic Peptide
LKKYKVPQLEIVPNSAEERLHSM

SEQ ID NO: 1082 - protein, 13 aa, Artificial Sequence
  Description of Artificial Sequence: Synthetic Peptide
QKLGNQWAVGHLM

SEQ ID NO: 1083 - protein, 7 aa, Artificial Sequence
  Description of Artificial Sequence: Synthetic Peptide
WAVGHLM

SEQ ID NO: 1084 - protein, 14 aa, Artificial Sequence
  Description of Artificial Sequence: Synthetic Peptide
EQRLGNQWAVGHLM

SEQ ID NO: 1085 - protein, 14 aa, Artificial Sequence
  Description of Artificial Sequence: Synthetic Peptide
EQRLGNQWAVGHLL

SEQ ID NO: 1086 - protein, 8 aa, Artificial Sequence
  Description of Artificial Sequence: Synthetic Peptide
FQWAVGHL

SEQ ID NO: 1087 - protein, 13 aa, Artificial Sequence
  Description of Artificial Sequence: Synthetic Peptide
QRLGNQWAVGFLM

SEQ ID NO: 1088 - protein, 13 aa, Artificial Sequence
  Description of Artificial Sequence: Synthetic Peptide
QRLGNQWAVGFLL

SEQ ID NO: 1089 - protein, 13 aa, Artificial Sequence
  Description of Artificial Sequence: Synthetic Peptide
QRYGNQWAVGHLM

SEQ ID NO: 1090 - protein, 13 aa, Artificial Sequence
  Description of Artificial Sequence: Synthetic Peptide
QRYGNQWAVGFLM

SEQ ID NO: 1091 - protein, 21 aa, Artificial Sequence
  Description of Artificial Sequence: Synthetic Peptide
MPLPPHPGHPGYINFSYEVLT

SEQ ID NO: 1092 - protein, 6 aa, Artificial Sequence
  Description of Artificial Sequence: Synthetic Peptide
PFYGPV

SEQ ID NO: 1093 - protein, 47 aa, Artificial Sequence
  Description of Artificial Sequence: Synthetic Peptide
YLYQWLGAPVPYPDPLEPRRVCLNPDCDELADHIGFQEAYRRFYGPV

SEQ ID NO: 1094 - protein, 6 aa, Artificial Sequence
  Description of Artificial Sequence: Synthetic Peptide
LVVYPW

SEQ ID NO: 1095 - protein, 46 aa, Artificial Sequence
  Description of Artificial Sequence: Synthetic Peptide
YLYQWLGAPVPYPDPLPRRVCLNPDCDELADHIGFQEAYRRFYGPV

SEQ ID NO: 1096 - protein, 13 aa, Artificial Sequence
  Description of Artificial Sequence: Synthetic Peptide
GFQEAYRRFYGPV

SEQ ID NO: 1097 - protein, 13 aa, Artificial Sequence
  Description of Artificial Sequence: Synthetic Peptide
PYQEAFRRFFGPV

SEQ ID NO: 1098 - protein, 48 aa, Artificial Sequence
  Description of Artificial Sequence: Synthetic Peptide
VPIYEKKYGQVPMCDAGEQCAVRKGARIGKLCDCPRGTSCNSFLLKCL

SEQ ID NO: 1099 - protein, 48 aa, Artificial Sequence; identical to SEQ ID NO: 1098
  Description of Artificial Sequence: Synthetic Peptide

SEQ ID NO: 1100 - protein, 48 aa, Artificial Sequence; identical to SEQ ID NO: 1098
  Description of Artificial Sequence: Synthetic Peptide

SEQ ID NO: 1101 - protein, 28 aa, Artificial Sequence
  Description of Artificial Sequence: Synthetic Peptide
AGATVQVTLDGVPAAAPGQPAQLQLNAT

SEQ ID NO: 1102 - protein, 5 aa, Artificial Sequence
  Description of Artificial Sequence: Synthetic Peptide
FLFLF

SEQ ID NO: 1103 - protein, 30 aa, Artificial Sequence
  Description of Artificial Sequence: Synthetic Peptide
ACYCRIPACIAGERRYGTCIYQGRLWAFCC

SEQ ID NO: 1104 - protein, 3 aa, Artificial Sequence
  Description of Artificial Sequence: Synthetic Peptide
MLF

SEQ ID NO: 1105 - protein, 4 aa, Artificial Sequence
  Description of Artificial Sequence: Synthetic Peptide
MLFK

SEQ ID NO: 1106 - protein, 4 aa, Artificial Sequence
  Description of Artificial Sequence: Synthetic Peptide
MLFK

SEQ ID NO: 1107 - protein, 6 aa, Artificial Sequence [sequence omitted]

SEQ ID NO: 1108 - protein, 25 aa, Artificial Sequence
  Description of Artificial Sequence: Synthetic Peptide
MLTELEKALNSIIDVYHKYSLIKGN

SEQ ID NO: 1109 - protein, 19 aa, Artificial Sequence
  Description of Artificial Sequence: Synthetic Peptide
HWDTTQSLKQLEERAAWNV

SEQ ID NO: 1110 - protein, 20 aa, Artificial Sequence
  Description of Artificial Sequence: Synthetic Peptide
GPVSAVLTELRCTCLRVTLR

SEQ ID NO: 1111 - protein, 21 aa, Artificial Sequence
  Description of Artificial Sequence: Synthetic Peptide
IQRTPKIQVYSRHPAENGKSN

SEQ ID NO: 1112 - protein, 11 aa, Artificial Sequence [sequence omitted]

SEQ ID NO: 1113 - protein, 19 aa, Artificial Sequence
  Description of Artificial Sequence: Synthetic Peptide
YSDDEGASWSDLDIVSFSK

SEQ ID NO: 1114 - protein, 18 aa, Artificial Sequence
  Description of Artificial Sequence: Synthetic Peptide
VARTLLVFEVQQPFLFVL

SEQ ID NO: 1115 - protein, 14 aa, Artificial Sequence [sequence omitted]

SEQ ID NO: 1116 - protein, 10 aa, Artificial Sequence
  Description of Artificial Sequence: Synthetic Peptide
CNTGQLCPVE

SEQ ID NO: 1117 - protein, 18 aa, Artificial Sequence [sequence omitted]

SEQ ID NO: 1118 - protein, 19 aa, Artificial Sequence
  Description of Artificial Sequence: Synthetic Peptide
LHEWTKPENLDFIEVNVLP

SEQ ID NO: 1119 - protein, 29 aa, Artificial Sequence
  Description of Artificial Sequence: Synthetic Peptide
VLELPYQGEELSMVILLPDDIEDESTGLK

SEQ ID NO: 1120 - protein, 19 aa, Artificial Sequence
  Description of Artificial Sequence: Synthetic Peptide
TYGADLASVDFQHASEDAR

SEQ ID NO: 1121 - protein, 12 aa, Artificial Sequence
  Description of Artificial Sequence: Synthetic Peptide
ERPPLQQPPHRD

SEQ ID NO: 1122 - protein, 29 aa, Artificial Sequence
  Description of Artificial Sequence: Synthetic Peptide
YERPPLQQPPHRDKKPCKNFFWKTFSSCK

SEQ ID NO: 1123 - protein, 20 aa, Artificial Sequence
  Description of Artificial Sequence: Synthetic Peptide
SALPLESGPTGQDSVQDATG

SEQ ID NO: 1124 - protein, 31 aa, Artificial Sequence
  Description of Artificial Sequence: Synthetic Peptide
TGLLTFLAWWHEWASQDSSSTAFEGGTPELS

SEQ ID NO: 1125 - protein, 4 aa, Artificial Sequence
  Description of Artificial Sequence: Synthetic Peptide
RGDC

SEQ ID NO: 1126 - protein, 4 aa, Artificial Sequence
  Description of Artificial Sequence: Synthetic Peptide
RGDS

SEQ ID NO: 1127 - protein, 4 aa, Artificial Sequence
  Description of Artificial Sequence: Synthetic Peptide
RGDV

SEQ ID NO: 1128 - protein, 4 aa, Artificial Sequence
  Description of Artificial Sequence: Synthetic Peptide
RGES

SEQ ID NO: 1129 - protein, 7 aa, Artificial Sequence
  Description of Artificial Sequence: Synthetic Peptide
GRGDSPA

SEQ ID NO: 1130 - protein, 5 aa, Artificial Sequence
  Description of Artificial Sequence: Synthetic Peptide
RGDFV

SEQ ID NO: 1131 - protein, 12 aa, Artificial Sequence
  Description of Artificial Sequence: Synthetic Peptide
PLYKKIIKKLLS

SEQ ID NO: 1132 - protein, 49 aa, Artificial Sequence
  Description of Artificial Sequence: Synthetic Peptide
ECESGPCCRNCKFLKEGTICKRARGDDMDDYCNGKTCDCPRNPHKGPAT

SEQ ID NO: 1133 - protein, 7 aa, Artificial Sequence
  Description of Artificial Sequence: Synthetic Peptide
GRADSPK

SEQ ID NO: 1134 - protein, 37 aa, Artificial Sequence
  Description of Artificial Sequence: Synthetic Peptide
FNKHTEIIEEDTNKDKPSYQFGGHNSVDFEEDTLPKV

SEQ ID NO: 1135 - protein, 16 aa, Artificial Sequence
  Description of Artificial Sequence: Synthetic Peptide
ADSGEGDFLAEGGGVR

SEQ ID NO: 1136 - protein, 17 aa, Artificial Sequence
  Description of Artificial Sequence: Synthetic Peptide
YADSGEGDFLAEGGGVR

SEQ ID NO: 1137 - protein, 13 aa, Artificial Sequence
  Description of Artificial Sequence: Synthetic Peptide
GVNDNEEGFFSAR

SEQ ID NO: 1138 - protein, 14 aa, Artificial Sequence [sequence omitted]

SEQ ID NO: 1139 - protein, 14 aa, Artificial Sequence
  Description of Artificial Sequence: Synthetic Peptide
GVNDNEEGFFSARY

SEQ ID NO: 1140 - protein, 18 aa, Artificial Sequence
  Description of Artificial Sequence: Synthetic Peptide
YEKPGSPPREVVPRPRGV

SEQ ID NO: 1141 - protein, 8 aa, Artificial Sequence
  Description of Artificial Sequence: Synthetic Peptide
WQPPRARI

SEQ ID NO: 1142 - protein, 5 aa, Artificial Sequence
  Description of Artificial Sequence: Synthetic Peptide
EILDV

SEQ ID NO: 1143 - protein, 8 aa, Artificial Sequence
  Description of Artificial Sequence: Synthetic Peptide
EILDVPST

SEQ ID NO: 1144 - protein, 6 aa, Artificial Sequence
  Description of Artificial Sequence: Synthetic Peptide
GRADSP

SEQ ID NO: 1145 - protein, 5 aa, Artificial Sequence
  Description of Artificial Sequence: Synthetic Peptide
GRGDS

SEQ ID NO: 1146 - protein, 6 aa, Artificial Sequence
  Description of Artificial Sequence: Synthetic Peptide
GRGDSP

SEQ ID NO: 1147 - protein, 7 aa, Artificial Sequence
  Description of Artificial Sequence: Synthetic Peptide
GRGDSPC

SEQ ID NO: 1148 - protein, 6 aa, Artificial Sequence
  Description of Artificial Sequence: Synthetic Peptide
GRGDTP

SEQ ID NO: 1149 - protein, 5 aa, Artificial Sequence
  Description of Artificial Sequence: Synthetic Peptide
GRGES

SEQ ID NO: 1150 - protein, 6 aa, Artificial Sequence
  Description of Artificial Sequence: Synthetic Peptide
GRGESP

SEQ ID NO: 1151 - protein, 5 aa, Artificial Sequence
  Description of Artificial Sequence: Synthetic Peptide
GGDSP

SEQ ID NO: 1152 - protein, 15 aa, Artificial Sequence
  Description of Artificial Sequence: Synthetic Peptide
GQQHHLGGAKQAGDV

SEQ ID NO: 1153 - protein, 3 aa, Artificial Sequence
  Description of Artificial Sequence: Synthetic Peptide
GPR

SEQ ID NO: 1154 - protein, 10 aa, Artificial Sequence
  Description of Artificial Sequence: Synthetic Peptide
GRGDSPASSK

SEQ ID NO: 1155 - protein, 9 aa, Artificial Sequence
  Description of Artificial Sequence: Synthetic Peptide
GGRGDSPCA

SEQ ID NO: 1156 - protein, 6 aa, Artificial Sequence
  Description of Artificial Sequence: Synthetic Peptide
GRGDSP

SEQ ID NO: 1157 - protein, 6 aa, Artificial Sequence
  Description of Artificial Sequence: Synthetic Peptide
GRGDNP

SEQ ID NO: 1158 - protein, 8 aa, Artificial Sequence
  Description of Artificial Sequence: Synthetic Peptide
WQPPRARI

SEQ ID NO: 1159 - protein, 5 aa, Artificial Sequence
  Description of Artificial Sequence: Synthetic Peptide
YIGSR

SEQ ID NO: 1160 - protein, 3 aa, Artificial Sequence
  Description of Artificial Sequence: Synthetic Peptide
LDV

SEQ ID NO: 1161 - protein, 5 aa, Artificial Sequence
  Description of Artificial Sequence: Synthetic Peptide
LDVPS

SEQ ID NO: 1162 - protein, 4 aa, Artificial Sequence
  Description of Artificial Sequence: Synthetic Peptide
KGDS

SEQ ID NO: 1163 - protein, 6 aa, Artificial Sequence
  Description of Artificial Sequence: Synthetic Peptide
GAVSTA

SEQ ID NO: 1164 - protein, 6 aa, Artificial Sequence
  Description of Artificial Sequence: Synthetic Peptide
WTVPTA

SEQ ID NO: 1165 - protein, 5 aa, Artificial Sequence
  Description of Artificial Sequence: Synthetic Peptide
RGDSP

SEQ ID NO: 1166 - protein, 11 aa, Artificial Sequence
  Description of Artificial Sequence: Synthetic Peptide
TDVNGDGRHDL

SEQ ID NO: 1167 - protein, 4 aa, Artificial Sequence
  Description of Artificial Sequence: Synthetic Peptide
REDV

SEQ ID NO: 1168 - protein, 10 aa, Artificial Sequence
  Description of Artificial Sequence: Synthetic Peptide
RGDSPASSKP

SEQ ID NO: 1169 - protein, 4 aa, Artificial Sequence
  Description of Artificial Sequence: Synthetic Peptide
RGDT

SEQ ID NO: 1170 - protein, 3 aa, Artificial Sequence
  Description of Artificial Sequence: Synthetic Peptide
RDS

SEQ ID NO: 1171 - protein, 5 aa, Artificial Sequence
  Description of Artificial Sequence: Synthetic Peptide
SDGRG

SEQ ID NO: 1172 - protein, 4 aa, Artificial Sequence
  Description of Artificial Sequence: Synthetic Peptide
SDGR

SEQ ID NO: 1173 - protein, 5 aa, Artificial Sequence
  Description of Artificial Sequence: Synthetic Peptide
YRGDS

SEQ ID NO: 1174 - protein, 42 aa, Artificial Sequence
  Description of Artificial Sequence: Synthetic Peptide
YAKLLGHQNLKQKIKHVVKLKDENSQLKSEVSKLRCQLAKKK

SEQ ID NO: 1175 - protein, 4 aa, Artificial Sequence
  Description of Artificial Sequence: Synthetic Peptide
FMRF

SEQ ID NO: 1176 - protein, 4 aa, Artificial Sequence
  Description of Artificial Sequence: Synthetic Peptide
FMRF

SEQ ID NO: 1177 - protein, 4 aa, Artificial Sequence
  Description of Artificial Sequence: Synthetic Peptide
FMRF

SEQ ID NO: 1178 - protein, 4 aa, Artificial Sequence
  Description of Artificial Sequence: Synthetic Peptide
FMRF

SEQ ID NO: 1179 - protein, 5 aa, Artificial Sequence
  Description of Artificial Sequence: Synthetic Peptide
LPLRF

SEQ ID NO: 1180 - protein, 6 aa, Artificial Sequence
  Description of Artificial Sequence: Synthetic Peptide
YLPLRF

SEQ ID NO: 1181 - protein, 3 aa, Artificial Sequence
  Description of Artificial Sequence: Synthetic Peptide
WRF

SEQ ID NO: 1182 - protein, 5 aa, Artificial Sequence
  Description of Artificial Sequence: Synthetic Peptide
YFMRF

SEQ ID NO: 1183 - protein, 4 aa, Artificial Sequence
  Description of Artificial Sequence: Synthetic Peptide
YMRF

SEQ ID NO: 1184 - protein, 8 aa, Artificial Sequence
  Description of Artificial Sequence: Synthetic Peptide
SDRNFLRF

SEQ ID NO: 1185 - protein, 8 aa, Artificial Sequence
  Description of Artificial Sequence: Synthetic Peptide
SDRNFLRF

SEQ ID NO: 1186 - protein, 6 aa, Artificial Sequence
  Description of Artificial Sequence: Synthetic Peptide
DPFLRF

SEQ ID NO: 1187 - protein, 8 aa, Artificial Sequence
  Description of Artificial Sequence: Synthetic Peptide
EILEVPST

SEQ ID NO: 1188 - protein, 30 aa, Artificial Sequence
  Description of Artificial Sequence: Synthetic Peptide
GWTLNSAGYLLGPHAVGNHRSFSDKNGLTS

SEQ ID NO: 1189 - protein, 19 aa, Artificial Sequence
  Description of Artificial Sequence: Synthetic Peptide
GWTLNSAGYLLGPHAVGNH

SEQ ID NO: 1190 - protein, 30 aa, Artificial Sequence
  Description of Artificial Sequence: Synthetic Peptide
MARGSALLLASLLLAAALSASAGLWSPAKE

SEQ ID NO: 1191 - protein, 24 aa, Artificial Sequence
  Description of Artificial Sequence: Synthetic Peptide
ELRPEDDMKPGSFDRSIPENNIMR

SEQ ID NO: 1192 - protein, 35 aa, Artificial Sequence
  Description of Artificial Sequence: Synthetic Peptide
TIIEFLSFLHLKEAGALDRLLDLPAAASSEDIERS

SEQ ID NO: 1193 - protein, 29 aa, Artificial Sequence
  Description of Artificial Sequence: Synthetic Peptide
GWTLNSAGYLLGPHAIDNHRSFHDKYGLA

SEQ ID NO: 1194 - protein, 16 aa, Artificial Sequence
  Description of Artificial Sequence: Synthetic Peptide
GWTLNSAGYLLGPHAI

SEQ ID NO: 1195 - protein, 29 aa, Artificial Sequence
  Description of Artificial Sequence: Synthetic Peptide
GWTLNSAGYLLGPHAIDNHRSFSDKHGLT

SEQ ID NO: 1196 - protein, 40 aa, Artificial Sequence
  Description of Artificial Sequence: Synthetic Peptide
TKEKRGWTLNSAGYLLGPHAIDNHRSFSDKHGLTGKRELP

SEQ ID NO: 1197 - protein, 21 aa, Artificial Sequence
  Description of Artificial Sequence: Synthetic Peptide
GWTLNSAGYLLGPPPGFSPFR

SEQ ID NO: 1198 - protein, 20 aa, Artificial Sequence
  Description of Artificial Sequence: Synthetic Peptide
GWTLNSAGYLLGPPPALALA

SEQ ID NO: 1199 - protein, 24 aa, Artificial Sequence
  Description of Artificial Sequence: Synthetic Peptide
GWTLNSAGYLLGPRPKPQQWFWLL

SEQ ID NO: 1200 - protein, 41 aa, Artificial Sequence
  Description of Artificial Sequence: Synthetic Peptide
ELEPEDEARPGGFDRLQSEDKAIRTIMEFLAFLHLKEAGAL

SEQ ID NO: 1201 - protein, 26 aa, Artificial Sequence
  Description of Artificial Sequence: Synthetic Peptide
LQSEDKAIRTIMEFLAFLHLKEAGAL

SEQ ID NO: 1202 - protein, 17 aa, Artificial Sequence
  Description of Artificial Sequence: Synthetic Peptide
TIMEFLAFLHLKEAGAL

SEQ ID NO: 1203 - protein, 20 aa, Artificial Sequence
  Description of Artificial Sequence: Synthetic Peptide
GWTLNSAGYLLGPQQFFGLM

SEQ ID NO: 1204 - protein, 15 aa, Artificial Sequence
  Description of Artificial Sequence: Synthetic Peptide
GWTLNTAWWLLGPHA

SEQ ID NO: 1205 - protein, 15 aa, Artificial Sequence
  Description of Artificial Sequence: Synthetic Peptide
GWTLNTAWWLLGPHA

SEQ ID NO: 1206 - protein, 20 aa, Artificial Sequence
  Description of Artificial Sequence: Synthetic Peptide
GWTLNSAGYLLGPPPALALA

SEQ ID NO: 1207 - protein, 24 aa, Artificial Sequence
  Description of Artificial Sequence: Synthetic Peptide
GWTLNSAGYLLGPRPKPQQWFWLL

SEQ ID NO: 1208 - protein, 12 aa, Artificial Sequence
  Description of Artificial Sequence: Synthetic Peptide
DEPNSDQFIGLM

SEQ ID NO: 1209 - protein, 120 aa, Artificial Sequence
  Description of Artificial Sequence: Synthetic Peptide
KKKDKVKKGGPGSECAEWAWGPCTPSSKDCGVGFREGTCGAQTQRIRCRVPCNWKKEFGADCKKFENWGACDGGTGTKVRQGTLKKARYNAQCQETIRVTKPCTPKTKAKAKAKKGKGKD

SEQ ID NO: 1210 - protein, 61 aa, Artificial Sequence
  Description of Artificial Sequence: Synthetic Peptide
ADCKKFENWGACDGGTGTKVRQGTLKKARYNAQCQETIRVTKPCTPKTKAKAKAKKGKGKD

SEQ ID NO: 1211 - protein, 10 aa, Artificial Sequence
  Description of Artificial Sequence: Synthetic Peptide
CHSGYVGVRC

SEQ ID NO: 1212 - protein, 13 aa, Artificial Sequence
  Description of Artificial Sequence: Synthetic Peptide
ANFLVWEIVRKKP

SEQ ID NO: 1213 - protein, 50 aa, Artificial Sequence
  Description of Artificial Sequence: Synthetic Peptide
VVSHFNDCPDSHTQFCFHGTCRFLVQEDKPACVCHSGYVGARCEHADLLA

SEQ ID NO: 1214 - protein, 50 aa, Artificial Sequence
  Description of Artificial Sequence: Synthetic Peptide
VVSHFNKCPDSHTQYCFHGTCRFLVQEEKPACVCHSGYVGVRCEHADLLA

SEQ ID NO: 1215 - protein, 10 aa, Artificial Sequence
  Description of Artificial Sequence: Synthetic Peptide
CHSGYVGVRC

SEQ ID NO: 1216 - protein, 10 aa, Artificial Sequence
  Description of Artificial Sequence: Synthetic Peptide
CHSGYVGVRC

SEQ ID NO: 1217 - protein, 6 aa, Artificial Sequence
  Description of Artificial Sequence: Synthetic Peptide
PPGHFK

SEQ ID NO: 1218 - protein, 6 aa, Artificial Sequence
  Description of Artificial Sequence: Synthetic Peptide
RTGQYK

SEQ ID NO: 1219 - protein, 11 aa, Artificial Sequence
  Description of Artificial Sequence: Synthetic Peptide
FNLPLGNYKKP

SEQ ID NO: 1220 - protein, 24 aa, Artificial Sequence
  Description of Artificial Sequence: Synthetic Peptide
PALPEDGGSGAFPPGHFKDPKRLY

SEQ ID NO: 1221 - protein, 10 aa, Artificial Sequence
  Description of Artificial Sequence: Synthetic Peptide
HAEKHWFVGL

SEQ ID NO: 1222 - protein, 12 aa, Artificial Sequence
  Description of Artificial Sequence: Synthetic Peptide
CMHIESLDSYTC

SEQ ID NO: 1223 - protein, 12 aa, Artificial Sequence
  Description of Artificial Sequence: Synthetic Peptide
DVVDADEYLIPQ

SEQ ID NO: 1224 - protein, 12 aa, Artificial Sequence
  Description of Artificial Sequence: Synthetic Peptide
CYAAPLKPAKSC

SEQ ID NO: 1225 - protein, 18 aa, Artificial Sequence
  Description of Artificial Sequence: Synthetic Peptide
YFNKPTGYGSSSRRAPQT

SEQ ID NO: 1226 - protein, 14 aa, Artificial Sequence
  Description of Artificial Sequence: Synthetic Peptide
ALLETYCATPAKSE

SEQ ID NO: 1227 - protein, 12 aa, Artificial Sequence
  Description of Artificial Sequence: Synthetic Peptide
GYGSSSRRAPQT

SEQ ID NO: 1228 - protein, 8 aa, Artificial Sequence
  Description of Artificial Sequence: Synthetic Peptide
SRVSRRSR

SEQ ID NO: 1229 - protein, 9 aa, Artificial Sequence
  Description of Artificial Sequence: Synthetic Peptide
YSRVSRRSR

SEQ ID NO: 1230 - protein, 3 aa, Artificial Sequence
  Description of Artificial Sequence: Synthetic Peptide
GHK

SEQ ID NO: 1231 - protein, 22 aa, Artificial Sequence [sequence omitted]

SEQ ID NO: 1232 - protein, 24 aa, Artificial Sequence
  Description of Artificial Sequence: Synthetic Peptide
GKKEKPEKKVKKSDCGEWQWSVCV

SEQ ID NO: 1233 - protein, 6 aa, Artificial Sequence
  Description of Artificial Sequence: Synthetic Peptide
SFLPSS

SEQ ID NO: 1234 - protein, 15 aa, Artificial Sequence
  Description of Artificial Sequence: Synthetic Peptide
SAQTNRHILRFNRPF

SEQ ID NO: 1235 - protein, 18 aa, Artificial Sequence [sequence omitted]

SEQ ID NO: 1236 - protein, 18 aa, Artificial Sequence
  Description of Artificial Sequence: Synthetic Peptide
LAGETGQEAAPLDGVLAN

SEQ ID NO: 1237 - protein, 14 aa, Artificial Sequence
  Description of Artificial Sequence: Synthetic Peptide
ALKRQGRTLYGFGG

SEQ ID NO: 1238 - protein, 30 aa, Artificial Sequence
  Description of Artificial Sequence: Synthetic Peptide
GMDVLGRPKIPLETPAYTGQPWHCQHCFLL

SEQ ID NO: 1239 - protein, 43 aa, Artificial Sequence
  Description of Artificial Sequence: Synthetic Peptide
MNTITICKFDVLDAELLSTVEGGYSGKDCLKDMGGYALAGAGS

SEQ ID NO: 1240 - protein, 38 aa, Artificial Sequence
  Description of Artificial Sequence: Synthetic Peptide
GADKTVKGPDGLTALEATDNQAIDYGGFMEVVYVDATK

SEQ ID NO: 1241 - protein, 16 aa, Artificial Sequence
  Description of Artificial Sequence: Synthetic Peptide
CKQLQRDRQVYRATHR

SEQ ID NO: 1242 - protein, 17 aa, Artificial Sequence
  Description of Artificial Sequence: Synthetic Peptide
CEGNVRVSRELAGHTGY

SEQ ID NO: 1243 - protein, 16 aa, Artificial Sequence
  Description of Artificial Sequence: Synthetic Peptide
CGAGESGKSTIVKQMK

SEQ ID NO: 1244 - protein, 15 aa, Artificial Sequence
  Description of Artificial Sequence: Synthetic Peptide
CNLKEDGISAAKDVK

SEQ ID NO: 1245 - protein, 16 aa, Artificial Sequence
  Description of Artificial Sequence: Synthetic Peptide
CKQLQKDKQVYRATHR

SEQ ID NO: 1246 - protein, 11 aa, Artificial Sequence
  Description of Artificial Sequence: Synthetic Peptide
EEQGMLPEDLS

SEQ ID NO: 1247 - protein, 15 aa, Artificial Sequence
  Description of Artificial Sequence: Synthetic Peptide
PGTCEICAYAACTGC

SEQ ID NO: 1248 - protein, 15 aa, Artificial Sequence
  Description of Artificial Sequence: Synthetic Peptide
PNTCEICAYAACTGC

SEQ ID NO: 1249 - protein, 16 aa, Artificial Sequence
  Description of Artificial Sequence: Synthetic Peptide
NDDCELCVNVACTGCL

SEQ ID NO: 1250 - protein, 32 aa, Artificial Sequence
  Description of Artificial Sequence: Synthetic Peptide
STPLMSWPWSPSALRLLQRPPEEPAAHANCHR

SEQ ID NO: 1251 - protein, 33 aa, Artificial Sequence
  Description of Artificial Sequence: Synthetic Peptide
YSTPLMSWPWSPSALRLLQRPPEEPAAHANCHR

SEQ ID NO: 1252 - protein, 31 aa, Artificial Sequence
  Description of Artificial Sequence: Synthetic Peptide
HNKQEGRDHDKSKGHFHRVVIHHKGGKAHRG

SEQ ID NO: 1253 - protein, 32 aa, Artificial Sequence
  Description of Artificial Sequence: Synthetic Peptide
YHNKQEGRDHDKSKGHFHRVVIHHKGGKAHRG

SEQ ID NO: 1254 - protein, 32 aa, Artificial Sequence
  Description of Artificial Sequence: Synthetic Peptide
STAPLPWPWSPAALRLLQRPPEEPAVHADCHR

SEQ ID NO: 1255 - protein, 33 aa, Artificial Sequence
  Description of Artificial Sequence: Synthetic Peptide
YSTAPLPWPWSPAALRLLQRPPEEPAVHADCHR

SEQ ID NO: 1256 - protein, 17 aa, Artificial Sequence
  Description of Artificial Sequence: Synthetic Peptide
VQGETSNDKIPVALGLK

SEQ ID NO: 1257 - protein, 72 aa, Artificial Sequence
  Description of Artificial Sequence: Synthetic Peptide
APVANELRCQCLQTVAGIHFKNIQSLKVMPPGPHCTQTEVIATLKNGREACLDPEAPMVQKIVQKMLKGVPK

SEQ ID NO: 1258 - protein, 9 aa, Artificial Sequence
  Description of Artificial Sequence: Synthetic Peptide
VQGEESNDK

SEQ ID NO: 1259 - protein, 13 aa, Artificial Sequence
  Description of Artificial Sequence: Synthetic Peptide
ILNGINNYKNPKL

SEQ ID NO: 1260 - protein, 22 aa, Artificial Sequence
  Description of Artificial Sequence: Synthetic Peptide
FVQGEAIPMSIPPEDKIPVALG

SEQ ID NO: 1261 - protein, 13 aa, Artificial Sequence
  Description of Artificial Sequence: Synthetic Peptide
APVPPGEDSKDVA

SEQ ID NO: 1262 - protein, 21 aa, Artificial Sequence
  Description of Artificial Sequence: Synthetic Peptide
MVKQIESKTAFQEALDAAGDK

SEQ ID NO: 1263 - protein, 10 aa, Artificial Sequence
  Description of Artificial Sequence: Synthetic Peptide
AYVHDAPVRS

SEQ ID NO: 1264 - protein, 7 aa, Artificial Sequence
  Description of Artificial Sequence: Synthetic Peptide
PRKLYDK

SEQ ID NO: 1265 - protein, 12 aa, Artificial Sequence
  Description of Artificial Sequence: Synthetic Peptide
YTTNPRKLYDYK

SEQ ID NO: 1266 - protein, 24 aa, Artificial Sequence
  Description of Artificial Sequence: Synthetic Peptide
RNPDGDVGGPWAYTTNPRKLYDYK

SEQ ID NO: 1267 - protein, 12 aa, Artificial Sequence
  Description of Artificial Sequence: Synthetic Peptide
RNPDGDVGGPWK

SEQ ID NO: 1268 - protein, 8 aa, Artificial Sequence
  Description of Artificial Sequence: Synthetic Peptide
PRKLYDYK

SEQ ID NO: 1269 - protein, 12 aa, Artificial Sequence
  Description of Artificial Sequence: Synthetic Peptide
YTTNPRKLYDYK

SEQ ID NO: 1270 - protein, 11 aa, Artificial Sequence
  Description of Artificial Sequence: Synthetic Peptide
YTTNPRKLYDY

SEQ ID NO: 1271 - protein, 24 aa, Artificial Sequence
  Description of Artificial Sequence: Synthetic Peptide
RNPDGDVGGPWAYTTNPRKLYDYK

SEQ ID NO: 1272 - protein, 23 aa, Artificial Sequence
  Description of Artificial Sequence: Synthetic Peptide
RNPDGDVGGPWAYTTNPRKLYDY

SEQ ID NO: 1273 - protein, 7 aa, Artificial Sequence
  Description of Artificial Sequence: Synthetic Peptide
RKLYDYK

SEQ ID NO: 1274 - protein, 6 aa, Artificial Sequence
  Description of Artificial Sequence: Synthetic Peptide
RKLYDY

SEQ ID NO: 1275 - protein, 7 aa, Artificial Sequence
  Description of Artificial Sequence: Synthetic Peptide
PRKLYDK

SEQ ID NO: 1276 - protein, 6 aa, Artificial Sequence
  Description of Artificial Sequence: Synthetic Peptide
PRKLYD

SEQ ID NO: 1277 - protein, 8 aa, Artificial Sequence
  Description of Artificial Sequence: Synthetic Peptide
PRKLYDYK

SEQ ID NO: 1278 - protein, 4 aa, Artificial Sequence
  Description of Artificial Sequence: Synthetic Peptide
DGEA

SEQ ID NO: 1279 - protein, 6 aa, Artificial Sequence
  Description of Artificial Sequence: Synthetic Peptide
LGTIPG

SEQ ID NO: 1280 - protein, 23 aa, Artificial Sequence
  Description of Artificial Sequence: Synthetic Peptide
NISSEEKASWTRPEKQETLDGHM

SEQ ID NO: 1281 - protein, 17 aa, Artificial Sequence
  Description of Artificial Sequence: Synthetic Peptide
FNLDVRFLVVKEAVNPG

SEQ ID NO: 1282 - protein, 17 aa, Artificial Sequence
  Description of Artificial Sequence: Synthetic Peptide
APRQRQTLVLFPGDLRT

SEQ ID NO: 1283 - protein, 24 aa, Artificial Sequence
  Description of Artificial Sequence: Synthetic Peptide
CSCSPVHPQQAFCNADVVIRAKAV

SEQ ID NO: 1284 - protein, 24 aa, Artificial Sequence
  Description of Artificial Sequence: Synthetic Peptide
CSCSPVHPQQAFCNADVVIRAKAV

SEQ ID NO: 1285 - protein, 13 aa, Artificial Sequence
  Description of Artificial Sequence: Synthetic Peptide
NVIQISNDLENLR

SEQ ID NO: 1286 - protein, 35 aa, Artificial Sequence
  Description of Artificial Sequence: Synthetic Peptide
VPIQKVQDDTKTLIKTIVTRINDISHTQSVSSKQK

SEQ ID NO: 1287 - protein, 15 aa, Artificial Sequence
  Description of Artificial Sequence: Synthetic Peptide
YKVQDDTKTLIKTIV

SEQ ID NO: 1288 - protein, 15 aa, Artificial Sequence
  Description of Artificial Sequence: Synthetic Peptide
SCSLPQTSGLQKPES

SEQ ID NO: 1289 - protein, 10 aa, Artificial Sequence
  Description of Artificial Sequence: Synthetic Peptide
EDVDHVFLRF

SEQ ID NO: 1290 - protein, 7 aa, Artificial Sequence
  Description of Artificial Sequence: Synthetic Peptide
TSFTPRL

SEQ ID NO: 1291 - protein, 8 aa, Artificial Sequence
  Description of Artificial Sequence: Synthetic Peptide
DPAFNSWG

SEQ ID NO: 1292 - protein, 8 aa, Artificial Sequence
  Description of Artificial Sequence: Synthetic Peptide
DPGFSSWG

SEQ ID NO: 1293 - protein, 8 aa, Artificial Sequence
  Description of Artificial Sequence: Synthetic Peptide
DQGFNSWG

SEQ ID NO: 1294 - protein, 8 aa, Artificial Sequence
  Description of Artificial Sequence: Synthetic Peptide
DASFHSWG

SEQ ID NO: 1295 - protein, 8 aa, Artificial Sequence
  Description of Artificial Sequence: Synthetic Peptide
GSGFSSWG

SEQ ID NO: 1296 - protein, 8 aa, Artificial Sequence
  Description of Artificial Sequence: Synthetic Peptide
DPAFSSWG

SEQ ID NO: 1297 - protein, 8 aa, Artificial Sequence
  Description of Artificial Sequence: Synthetic Peptide
GASFYSWG

SEQ ID NO: 1298 - protein, 10 aa, Artificial Sequence
  Description of Artificial Sequence: Synthetic Peptide
IIGGRESRPH

SEQ ID NO: 1299 - protein, 38 aa, Artificial Sequence
  Description of Artificial Sequence: Synthetic Peptide
HSDGIFTDSYSRYRKQMAVKKYLAAVLGKRYKQRVKNK

SEQ ID NO: 1300 - protein, 30 aa, Artificial Sequence
  Description of Artificial Sequence: Synthetic Peptide
HSDGIFTDSYSRYRRQLAVRRYLAAVLGKR

SEQ ID NO: 1301 - protein, 21 aa, Artificial Sequence
  Description of Artificial Sequence: Synthetic Peptide
FTDSYSRYRKMAVKKYLAAVL

SEQ ID NO: 1302 - protein, 38 aa, Artificial Sequence
  Description of Artificial Sequence: Synthetic Peptide
HSDGIFTDSYSRYRKQMAVKKYLAAVLGKRYKQRIKNK

SEQ ID NO: 1303 - protein, 27 aa, Artificial Sequence
  Description of Artificial Sequence: Synthetic Peptide
HSDGIFTDSYSRYRKQMAVKKYLAAVL

SEQ ID NO: 1304 - protein, 22 aa, Artificial Sequence
  Description of Artificial Sequence: Synthetic Peptide
FTDSYSRYRKQMAVKKYLAAVL

SEQ ID NO: 1305 - protein, 38 aa, Artificial Sequence; identical to SEQ ID NO: 1299
  Description of Artificial Sequence: Synthetic Peptide

SEQ ID NO: 1306 - protein, 33 aa, Artificial Sequence
  Description of Artificial Sequence: Synthetic Peptide
FTDSYSRYRKQMAVKKYLAAVLGKRYKQRVKNK

SEQ ID NO: 1307 - protein, 23 aa, Artificial Sequence
  Description of Artificial Sequence: Synthetic Peptide
QMAVKKYLAAVLGKRYKQRVKNK

SEQ ID NO: 1308 - protein, 11 aa, Artificial Sequence
  Description of Artificial Sequence: Synthetic Peptide
GKRYKQRVKNK

SEQ ID NO: 1309 - protein, 8 aa, Artificial Sequence
  Description of Artificial Sequence: Synthetic Peptide
YKQRVKNK

SEQ ID NO: 1310 - protein, 29 aa, Artificial Sequence
  Description of Artificial Sequence: Synthetic Peptide
DVAHGILNEAYRKVLDQLSAGKHLQSLVA

SEQ ID NO: 1311 - protein, 29 aa, Artificial Sequence
  Description of Artificial Sequence: Synthetic Peptide
DVAHEILNEAYRKVLDQLSARKYLQSMVA

SEQ ID NO: 1312 - protein, 20 aa, Artificial Sequence
  Description of Artificial Sequence: Synthetic Peptide
SDEDSDGDRPQASPGLGPGP

SEQ ID NO: 1313 - protein, 52 aa, Artificial Sequence
  Description of Artificial Sequence: Synthetic Peptide
GESRSEALAVDGAGKPGAEEAQDPEGKGEQEHSQQKEEEEEMAVVPQGLFRG

SEQ ID NO: 1314 - protein, 29 aa, Artificial Sequence
  Description of Artificial Sequence: Synthetic Peptide
PEGKGEQEHSQQKEEEEEMAVVPQGLFRG

SEQ ID NO: 1315 - protein, 16 aa, Artificial Sequence
  Description of Artificial Sequence: Synthetic Peptide
EEEEEMAVVPQGLFRG

SEQ ID NO: 1316 - protein, 49 aa, Artificial Sequence
  Description of Artificial Sequence: Synthetic Peptide
GWPQAPAMDGAGKTGAEEAQPPEGKGAREHSRQEEEEETAGAPQGLFRG

SEQ ID NO: 1317 - protein, 48 aa, Artificial Sequence
  Description of Artificial Sequence: Synthetic Peptide
GWPQAPADGAGKTGAEEAQPPEGKGAREHSRQEEEEETAGAPQGLFRG

SEQ ID NO: 1318 - protein, 49 aa, Artificial Sequence
  Description of Artificial Sequence: Synthetic Peptide
YGWPQAPADGAGKTGAEEAQPPEGKGAREHSRQEEEEETAGAPQGLFRG

SEQ ID NO: 1319 - protein, 50 aa, Artificial Sequence
  Description of Artificial Sequence: Synthetic Peptide
YGWPQAPAMDGAGKTGAEEAQPPEGKGAREHSRQEEEEETAGAPQGLFRG

SEQ ID NO: 1320 - protein, 19 aa, Artificial Sequence
  Description of Artificial Sequence: Synthetic Peptide
LSFRAPAYGFRGPGLQLRR

SEQ ID NO: 1321 - protein, 51 aa, Artificial Sequence
  Description of Artificial Sequence: Synthetic Peptide
DDGQSESQAVNGKTGASEAVPSEGKGELEHSQQEEDGEEAMAGPPQGLFPG

SEQ ID NO: 1322 - protein, 52 aa, Artificial Sequence
  Description of Artificial Sequence: Synthetic Peptide
YDDGQSESQAVNGKTGASEAVPSEGKGELEHSQQEEDGEEAMAGPPQGLFPG

SEQ ID NO: 1323 - protein, 26 aa, Artificial Sequence
  Description of Artificial Sequence: Synthetic Peptide
GELEHSQQEEDGEEAMAGPPQGLFPG

SEQ ID NO: 1324 - protein, 17 aa, Artificial Sequence
  Description of Artificial Sequence: Synthetic Peptide
QEEEEETAGAPQGLFRG

SEQ ID NO: 1325 - protein, 2 aa, Artificial Sequence
  Description of Artificial Sequence: Synthetic Peptide
PG

SEQ ID NO: 1326 - protein, 1 aa, Artificial Sequence
  Description of Artificial Sequence: Synthetic Peptide
K

SEQ ID NO: 1327 - protein, 4 aa, Artificial Sequence
  Description of Artificial Sequence: Synthetic Peptide
GFAD

SEQ ID NO: 1328 - protein, 6 aa, Artificial Sequence
  Description of Artificial Sequence: Synthetic Peptide
DYVPML

SEQ ID NO: 1329 - protein, 6 aa, Artificial Sequence
  Description of Artificial Sequence: Synthetic Peptide
DYVPML

SEQ ID NO: 1330 - protein, 11 aa, Artificial Sequence
  Description of Artificial Sequence: Synthetic Peptide
QKRPSQRSKYL

SEQ ID NO: 1331 - protein, 12 aa, Artificial Sequence
  Description of Artificial Sequence: Synthetic Peptide
PLSRTLSVAAKK

SEQ ID NO: 1332 - protein, 14 aa, Artificial Sequence
  Description of Artificial Sequence: Synthetic Peptide
ARRPEGRTWAQPGY

SEQ ID NO: 1333 - protein, 6 aa, Artificial Sequence
  Description of Artificial Sequence: Synthetic Peptide
RGYSLG

SEQ ID NO: 1334 - protein, 13 aa, Artificial Sequence
  Description of Artificial Sequence: Synthetic Peptide
KKALRRQEAVDAL

SEQ ID NO: 1335 - protein, 25 aa, Artificial Sequence
  Description of Artificial Sequence: Synthetic Peptide
ITSFEEAKGLDRINERMPPRRDAMP

SEQ ID NO: 1336 - protein, 20 aa, Artificial Sequence
  Description of Artificial Sequence: Synthetic Peptide
LKKFNARRKLKGAILTTMLA

SEQ ID NO: 1337 - protein, 10 aa, Artificial Sequence
  Description of Artificial Sequence: Synthetic Peptide
PLSRTLSVSS

SEQ ID NO: 1338 - protein, 10 aa, Artificial Sequence
  Description of Artificial Sequence: Synthetic Peptide
PLRRTLSVAA

SEQ ID NO: 1339 - protein, 17 aa, Artificial Sequence
  Description of Artificial Sequence: Synthetic Peptide
LQNRRGLDLLFLKEGGL

SEQ ID NO: 1340 - protein, 8 aa, Artificial Sequence
  Description of Artificial Sequence: Synthetic Peptide
CLRRASLG

SEQ ID NO: 1341 - protein, 7 aa, Artificial Sequence
  Description of Artificial Sequence: Synthetic Peptide
FKKSFKL

SEQ ID NO: 1342 - protein, 13 aa, Artificial Sequence
  Description of Artificial Sequence: Synthetic Peptide
KKALHRQETVDAL

SEQ ID NO: 1343 - protein, 6 aa, Artificial Sequence
  Description of Artificial Sequence: Synthetic Peptide
KRTLRR

SEQ ID NO: 1344 - protein, 14 aa, Artificial Sequence
  Description of Artificial Sequence: Synthetic Peptide
RTKRSGSVYEPLKI

SEQ ID NO: 1345 - protein, 26 aa, Artificial Sequence
  Description of Artificial Sequence: Synthetic Peptide
GIGAVLKVLTTGLPALISWIKRKRQQ

SEQ ID NO: 1346 - protein, 9 aa, Artificial Sequence
  Description of Artificial Sequence: Synthetic Peptide
RRKASGPPV

SEQ ID NO: 1347 - protein, 17 aa, Artificial Sequence
  Description of Artificial Sequence: Synthetic Peptide
RFARKGALRQKNVHEVK

SEQ ID NO: 1348 - protein, 18 aa, Artificial Sequence
  Description of Artificial Sequence: Synthetic Peptide
RFARKGALEQKNVHEVKN

SEQ ID NO: 1349 - protein, 14 aa, Artificial Sequence
  Description of Artificial Sequence: Synthetic Peptide
SFVNSEFLKPEVKS

SEQ ID NO: 1350 - protein, 11 aa, Artificial Sequence
  Description of Artificial Sequence: Synthetic Peptide
SYTNPEFVINV

SEQ ID NO: 1351 - protein, 15 aa, Artificial Sequence
  Description of Artificial Sequence: Synthetic Peptide
AGNKVISPSEDRRQC

SEQ ID NO: 1352 - protein, 18 aa, Artificial Sequence
  Description of Artificial Sequence: Synthetic Peptide
GPKTPEEKTANTISKFDC

SEQ ID NO: 1353 - protein, 29 aa, Artificial Sequence
  Description of Artificial Sequence: Synthetic Peptide
LLYEMLAGQAPFEGEDEDELFQSIMEHNV

SEQ ID NO: 1354 - protein, 14 aa, Artificial Sequence
  Description of Artificial Sequence: Synthetic Peptide
NYPLELYERVRTGC

SEQ ID NO: 1355 - protein, 9 aa, Artificial Sequence
  Description of Artificial Sequence: Synthetic Peptide
VRKRTLRRL

SEQ ID NO: 1356 - protein, 8 aa, Artificial Sequence
  Description of Artificial Sequence: Synthetic Peptide
CDNQIKKM

SEQ ID NO: 1357 - protein, 5 aa, Artificial Sequence
  Description of Artificial Sequence: Synthetic Peptide
IYGEF

SEQ ID NO: 1358 - protein, 5 aa, Artificial Sequence
  Description of Artificial Sequence: Synthetic Peptide
IYGEF

SEQ ID NO: 1359 - protein, 17 aa, Artificial Sequence
  Description of Artificial Sequence: Synthetic Peptide
TYADFIASGRTGRRNAI

SEQ ID NO: 1360 - protein, 11 aa, Artificial Sequence
  Description of Artificial Sequence: Synthetic Peptide
QKRPSQRSKYL

SEQ ID NO: 1361 - protein, 9 aa, Artificial Sequence
  Description of Artificial Sequence: Synthetic Peptide
RREEETEEE

SEQ ID NO: 1362 - protein, 7 aa, Artificial Sequence
  Description of Artificial Sequence: Synthetic Peptide
RRKASGP

SEQ ID NO: 1363 - protein, 13 aa, Artificial Sequence
  Description of Artificial Sequence: Synthetic Peptide
RRLIEDNEYTARG

SEQ ID NO: 1364 - protein, 15 aa, Artificial Sequence
  Description of Artificial Sequence: Synthetic Peptide
PLARTLSVAGLPGKK

SEQ ID NO: 1365 - protein, 32 aa, Artificial Sequence
  Description of Artificial Sequence: Synthetic Peptide
KEAKEKRQEQIAKRRRLSSLRASTSKSGGSQK

SEQ ID NO: 1366 - protein, 20 aa, Artificial Sequence
  Description of Artificial Sequence: Synthetic Peptide
YSFVHHGFFNFRVSWREMLA

SEQ ID NO: 1367 - protein, 21 aa, Artificial Sequence
  Description of Artificial Sequence: Synthetic Peptide
VAPSDSIQAEEWYFGKITRRE

SEQ ID NO: 1368 - protein, 6 aa, Artificial Sequence
  Description of Artificial Sequence: Synthetic Peptide
HRHFLR

SEQ ID NO: 1369 - protein, 25 aa, Artificial Sequence [sequence omitted]

SEQ ID NO: 1370 - protein, 14 aa, Artificial Sequence
  Description of Artificial Sequence: Synthetic Peptide
MYSNVIGTVTSGKR

SEQ ID NO: 1371 - protein, 25 aa, Artificial Sequence
  Description of Artificial Sequence: Synthetic Peptide
FYKADGVVFSIYDVPGRQVPLSARG

SEQ ID NO: 1372 - protein, 20 aa, Artificial Sequence
  Description of Artificial Sequence: Synthetic Peptide
WSPQEEDRIIEGGIYDADLN

SEQ ID NO: 1373 - protein, 20 aa, Artificial Sequence [sequence omitted]

SEQ ID NO: 1374 - protein, 11 aa, Artificial Sequence
  Description of Artificial Sequence: Synthetic Peptide
CSPCHAMKMNI

SEQ ID NO: 1375 - protein, 27 aa, Artificial Sequence
  Description of Artificial Sequence: Synthetic Peptide
EVSFLNCSLDNGGCTPLLPRGGGLAAL

SEQ ID NO: 1376 - protein, 33 aa, Artificial Sequence
  Description of Artificial Sequence: Synthetic Peptide
MAPEEIIMDRPFLFVVRHNPTGTVLFMGQVMEP

SEQ ID NO: 1377 - protein, 36 aa, Artificial Sequence
  Description of Artificial Sequence: Synthetic Peptide
CENGGFCSGVCHNLPGTFECICGPDSALVRHIGTDC

SEQ ID NO: 1378 - protein, 24 aa, Artificial Sequence
  Description of Artificial Sequence: Synthetic Peptide
HPPCCLYGKCRRYPGCSSASCCQL

SEQ ID NO: 1379 - protein, 48 aa, Artificial Sequence
  Description of Artificial Sequence: Synthetic Peptide
EDNCIAEDYGKCTWGGTKCCRGRPCRCSMIGTNCECTPRLIMEGLSFA

SEQ ID NO: 1380 - protein, 35 aa, Artificial Sequence
  Description of Artificial Sequence: Synthetic Peptide
GGCLPHNRFCNALSGPRCCSGLKCKELSIWDSRCL

SEQ ID NO: 1381 - protein, 18 aa, Artificial Sequence
  Description of Artificial Sequence: Synthetic Peptide
CNCKAPETALCARRCQQH

SEQ ID NO: 1382 - protein, 60 aa, Artificial Sequence
  Description of Artificial Sequence: Synthetic Peptide
WQPPWYCKEPVRIGSCKKQFSSFYFKWTAKKCLPFLFSGCGGNANRFQTIGECRKKCLGK

SEQ ID NO: 1383 - protein, 60 aa, Artificial Sequence
  Description of Artificial Sequence: Synthetic Peptide
RICYIHKASLPRATKTCVENTCYKMFIRTQREYISERGCGCPTAMWPYQTECCKGDRCNK

SEQ ID NO: 1384 - protein, 36 aa, Artificial Sequence
  Description of Artificial Sequence: Synthetic Peptide
FTNVSCTTSKECWSVCQRLHNTSRGKCMNKKCRCYS

SEQ ID NO: 1385 - protein, 36 aa, Artificial Sequence
  Description of Artificial Sequence: Synthetic Peptide
MCMPCFTTDHQMARKCDDCCGGKGRGKCYGPQCLCR

SEQ ID NO: 1386 - protein, 13 aa, Artificial Sequence
  Description of Artificial Sequence: Synthetic Peptide
ECCNPACGRHYSC

SEQ ID NO: 1387 - protein, 31 aa, Artificial Sequence
  Description of Artificial Sequence: Synthetic Peptide
ACSGRGSRCQCCMGLRCGRGNPQKCIGAHDV

SEQ ID NO: 1388 - protein, 14 aa, Artificial Sequence
  Description of Artificial Sequence: Synthetic Peptide
GRCCHPACGKNYSC

SEQ ID NO: 1389 - protein, 17 aa, Artificial Sequence
  Description of Artificial Sequence: Synthetic Peptide
RDCCYHPTCNMSNPQIC

SEQ ID NO: 1390 - protein, 13 aa, Artificial Sequence
  Description of Artificial Sequence: Synthetic Peptide
YCCHPACGKNFDC

SEQ ID NO: 1391 - protein, 12 aa, Artificial Sequence
  Description of Artificial Sequence: Synthetic Peptide
GCCSDPRCAWRC

SEQ ID NO: 1392 - protein, 13 aa, Artificial Sequence
  Description of Artificial Sequence: Synthetic Peptide
ICCNPACGPKYSC

SEQ ID NO: 1393 - protein, 19 aa, Artificial Sequence
  Description of Artificial Sequence: Synthetic Peptide
RDCCTRKCKDRRCKMKCCA

SEQ ID NO: 1394 - protein, 24 aa, Artificial Sequence
  Description of Artificial Sequence: Synthetic Peptide
CKSGSSCSTSYNCCRSCNYTKRCY

SEQ ID NO: 1395 - protein, 25 aa, Artificial Sequence
  Description of Artificial Sequence: Synthetic Peptide
CKGKGAKCSRLMYDCCTGSCRSGKC

SEQ ID NO: 1396 - protein, 26 aa, Artificial Sequence
  Description of Artificial Sequence: Synthetic Peptide
CKGKGAPCRKTMYDCCSGSCGRRGKC

SEQ ID NO: 1397 - protein, 26 aa, Artificial Sequence
  Description of Artificial Sequence: Synthetic Peptide
CKLKGQSCRKTSYDCCSGSCGRSGKC

SEQ ID NO: 1398 - protein, 10 aa, Artificial Sequence
  Description of Artificial Sequence: Synthetic Peptide
KTKCKFLKKC

SEQ ID NO: 1399 - protein, 19 aa, Artificial Sequence
  Description of Artificial Sequence: Synthetic Peptide
RDCCTKKCKDRQCKQRCCA

SEQ ID NO: 1400 - protein, 37 aa, Artificial Sequence
  Description of Artificial Sequence: Synthetic Peptide
EFTDVDCSVSKECWSVCKDLFGVDRGKCMGKKCRCYQ

SEQ ID NO: 1401 - protein, 37 aa, Artificial Sequence
  Description of Artificial Sequence: Synthetic Peptide
GVEINVKCSGSPQCLKPCKDAGMRFGKCMNRKCHCTP

SEQ ID NO: 1402 - protein, 37 aa, Artificial Sequence; identical to SEQ ID NO: 1401
  Description of Artificial Sequence: Synthetic Peptide

SEQ ID NO: 1403 - protein, 22 aa, Artificial Sequence
  Description of Artificial Sequence: Synthetic Peptide
IKCNCKRHVIKPHICRKICGKN

SEQ ID NO: 1404 - protein, 39 aa, Artificial Sequence
  Description of Artificial Sequence: Synthetic Peptide
TIINVKCTSPKQCLPPCKAQFGQSAGAKCMNGKCKCYPH

SEQ ID NO: 1405 - protein, 4 aa, Artificial Sequence
  Description of Artificial Sequence: Synthetic Peptide
FDRA

SEQ ID NO: 1406 - protein, 44 aa, Artificial Sequence
  Description of Artificial Sequence: Synthetic Peptide
ADCSATGDTCDHTKKCCDDCYTCRCGTPWGANCRCDYYKARCDT

SEQ ID NO: 1407 - protein, 31 aa, Artificial Sequence
  Description of Artificial Sequence: Synthetic Peptide
AFCNLRMCQLSCRSLGLLGKCIGDKCECVKH

SEQ ID NO: 1408 - protein, 35 aa, Artificial Sequence
  Description of Artificial Sequence: Synthetic Peptide
RSCIDTIPKSRCTAFQCKHSMKYRLSFCRKTCGTC

SEQ ID NO: 1409 - protein, 14 aa, Artificial Sequence
  Description of Artificial Sequence: Synthetic Peptide
FLPLILGKLVKGLL

SEQ ID NO: 1410 - protein, 14 aa, Artificial Sequence
  Description of Artificial Sequence: Synthetic Peptide
INLKAIAALVKKVL

SEQ ID NO: 1411 - protein, 14 aa, Artificial Sequence
  Description of Artificial Sequence: Synthetic Peptide
INLKALAALAKKIL

SEQ ID NO: 1412 - protein, 14 aa, Artificial Sequence
  Description of Artificial Sequence: Synthetic Peptide
INLKALAALAKALL

SEQ ID NO: 1413 - protein, 14 aa, Artificial Sequence
  Description of Artificial Sequence: Synthetic Peptide
INLKALAALAKRLL

SEQ ID NO: 1414 - protein, 14 aa, Artificial Sequence
  Description of Artificial Sequence: Synthetic Peptide
INLKAKAALAKKLL

SEQ ID NO: 1415 - protein, 14 aa, Artificial Sequence
  Description of Artificial Sequence: Synthetic Peptide
INWKGIAAMAKKLL

SEQ ID NO: 1416 - protein, 21 aa, Artificial Sequence
  Description of Artificial Sequence: Synthetic Peptide
FMSSHQSQASLELAIKQWGSQ

SEQ ID NO: 1417 - protein, 20 aa, Artificial Sequence
  Description of Artificial Sequence: Synthetic Peptide
FNKITPNLAEFAFSLYRQLA

SEQ ID NO: 1418 - protein, 34 aa, Artificial Sequence
  Description of Artificial Sequence: Synthetic Peptide
WSPKEEDRIIPGGIYNADLNDEWVQRALHFAISE

SEQ ID NO: 1419 - protein, 36 aa, Artificial Sequence
  Description of Artificial Sequence: Synthetic Peptide
YTSLIHSLIEESQNQQEKNEQELLELDKWASLWNWF

SEQ ID NO: 1420 - protein, 38 aa, Artificial Sequence
  Description of Artificial Sequence: Synthetic Peptide
NNLLRAIEAQQHLLQLTVWQIKQLQARILAVERYLKDQ

SEQ ID NO: 1421 - protein, 36 aa, Artificial Sequence
  Description of Artificial Sequence: Synthetic Peptide
YTNTIYTLLEESQNQQEKNEQELLELDKWASLWNWF

SEQ ID NO: 1422 - protein, 36 aa, Artificial Sequence
  Description of Artificial Sequence: Synthetic Peptide
YTGIIYNLLEESQNQQEKNEQELLELDKWANLWNWF

SEQ ID NO: 1423 - protein, 36 aa, Artificial Sequence
  Description of Artificial Sequence: Synthetic Peptide
YTSLIYSLLEKSQTQQEKNEQELLELDKWASLWNWF

SEQ ID NO: 1424 - protein, 36 aa, Artificial Sequence
  Description of Artificial Sequence: Synthetic Peptide
LEANISKSLEQAQIQQEKNMYELQKLNSWDIFGNWF

SEQ ID NO: 1425 - protein, 36 aa, Artificial Sequence
  Description of Artificial Sequence: Synthetic Peptide
LEANISQSLEQAQIQQEKNMYELQKLNSWDVFTNWL

SEQ ID NO: 1426 - protein, 41 aa, Artificial Sequence
  Description of Artificial Sequence: Synthetic Peptide
CGGNNLLRAIEAQQHLLQLTVWGIKQLQARILAVERYLKDQ

SEQ ID NO: 1427 - protein, 38 aa, Artificial Sequence
  Description of Artificial Sequence: Synthetic Peptide
QQLLDVVKRQQEMLRLTVWGTKNLQARVTAIEKYLKDQ

SEQ ID NO: 1428 - protein, 46 aa, Artificial Sequence
  Description of Artificial Sequence: Synthetic Peptide
YTSVITIELSNIKENKCNGAKVKLIKQELDKYKNAVTELQLLMQST

SEQ ID NO: 1429 - protein, 54 aa, Artificial Sequence
  Description of Artificial Sequence: Synthetic Peptide
ASGVAVSKVLHLEGEVNKIALLSTNKAVVSLSNGVSVLTSKVLDLKNYIDKQLL

SEQ ID NO: 1430 - protein, 53 aa, Artificial Sequence
  Description of Artificial Sequence: Synthetic Peptide
GEPIINFYDPLVFPSDEFDASISQVNEKINQSLAFIRKSDELLHNVNAGKSTT

SEQ ID NO: 1431 - protein, 48 aa, Artificial Sequence
  Description of Artificial Sequence: Synthetic Peptide
YTSVITIELSNIKENKCNGTDAKVKLIKQELDKYKNAVTELQLLMQST

SEQ ID NO: 1432 - protein, 34 aa, Artificial Sequence
  Description of Artificial Sequence: Synthetic Peptide
YTSVITIELSNIKENKCNGDAKVKLIKQELDKYK

SEQ ID NO: 1433 - protein, 34 aa, Artificial Sequence
  Description of Artificial Sequence: Synthetic Peptide
TSVITIELSNIKENKCNGDAKVKLIKQELDKYKN

SEQ ID NO: 1434 - protein, 34 aa, Artificial Sequence
  Description of Artificial Sequence: Synthetic Peptide
VITIELSNIKENKCNGDAKVKLIKQELDKYKNAV

SEQ ID NO: 1435 - protein, 34 aa, Artificial Sequence
  Description of Artificial Sequence: Synthetic Peptide
VITIELSNIKENKMNGDAKVKLIKQELDKYKNAV

SEQ ID NO: 1436 - protein, 33 aa, Artificial Sequence
  Description of Artificial Sequence: Synthetic Peptide
VAVSKVLHLEGEVNKIALLSTNKAVVSLSNGVS

SEQ ID NO: 1437 - protein, 33 aa, Artificial Sequence
  Description of Artificial Sequence: Synthetic Peptide
AVSKVLHLEGEVNKIALLSTNKAVVSLSNGVSV

SEQ ID NO: 1438 - protein, 33 aa, Artificial Sequence
  Description of Artificial Sequence: Synthetic Peptide
VSKVLHLEGEVNKIALLSTNKAVVSLSNGVSVL

SEQ ID NO: 1439 - protein, 33 aa, Artificial Sequence
  Description of Artificial Sequence: Synthetic Peptide
SKVLHLEGEVNKIALLSTNKAVVSLSNGVSVLT

SEQ ID NO: 1440 - protein, 33 aa, Artificial Sequence
  Description of Artificial Sequence: Synthetic Peptide
KVLHLEGEVNKIALLSTNKAVVSLSNGVSVLTS

SEQ ID NO: 1441 - protein, 33 aa, Artificial Sequence
  Description of Artificial Sequence: Synthetic Peptide
LEGEVNKIALLSTNKAVVSLSNGVSVLTSKVLD

SEQ ID NO: 1442 - protein, 33 aa, Artificial Sequence
  Description of Artificial Sequence: Synthetic Peptide
GEVNKIALLSTNKAVVSLSNGVSVLTSKVLDLK

SEQ ID NO: 1443 - protein, 33 aa, Artificial Sequence
  Description of Artificial Sequence: Synthetic Peptide
EVNKIALLSTNKAVVSLSNGVSVLTSKVLDLKN

SEQ ID NO: 1444 - protein, 33 aa, Artificial Sequence
  Description of Artificial Sequence: Synthetic Peptide
VNKIALLSTNKAVVSLSNGVSVLTSKVLDLKNY

SEQ ID NO: 1445 - protein, 33 aa, Artificial Sequence
  Description of Artificial Sequence: Synthetic Peptide
NKIALLSTNKAVVSLSNGVSVLTSKVLDLKNYI

SEQ ID NO: 1446 - protein, 33 aa, Artificial Sequence
  Description of Artificial Sequence: Synthetic Peptide
KIALLSTNKAVVSLSNGVSVLTSKVLDLKNYID

SEQ ID NO: 1447 - protein, 33 aa, Artificial Sequence
  Description of Artificial Sequence: Synthetic Peptide
IALLSTNKAVVSLSNGVSVLTSKVLDLKNYIDK

SEQ ID NO: 1448 - protein, 33 aa, Artificial Sequence
  Description of Artificial Sequence: Synthetic Peptide
ALLSTNKAVVSLSNGVSVLTSKVLDLKNYIDKQ

SEQ ID NO: 1449 - protein, 70 aa, Artificial Sequence
  Description of Artificial Sequence: Synthetic Peptide
GTIALGVATSAQITAAVALVEAKQARSDIEKLKEAIRDTNKAVQSVQSSIGNLIVAIKSVQDYVNKEIVP

SEQ ID NO: 1450 - protein, 56 aa, Artificial Sequence
  Description of Artificial Sequence: Synthetic Peptide
YTPNDITLNNSVALDPIDISIELNKAKSDLEESKEWIRRSNQKLDSIGNWHQSSTT

SEQ ID NO: 1451 - protein, 35 aa, Artificial Sequence
  Description of Artificial Sequence: Synthetic Peptide
TLNNSVALDPIDISIELNKAKSDLEESKEWIRRSN

SEQ ID NO: 1452 - protein, 35 aa, Artificial Sequence
  Description of Artificial Sequence: Synthetic Peptide
LNNSVALDPIDISIELNKAKSDLEESKEWIRRSNQ

SEQ ID NO: 1453 - protein, 35 aa, Artificial Sequence
  Description of Artificial Sequence: Synthetic Peptide
NNSVALDPIDISIELNKAKSDLEESKEWIRRSNQK

SEQ ID NO: 1454 - protein, 35 aa, Artificial Sequence
  Description of Artificial Sequence: Synthetic Peptide
NSVALDPIDISIELNKAKSDLEESKEWIRRSNQKL

SEQ ID NO: 1455 - protein, 35 aa, Artificial Sequence
  Description of Artificial Sequence: Synthetic Peptide
SVALDPIDISIELNKAKSDLEESKEWIRRSNQKLD

SEQ ID NO: 1456 - protein, 35 aa, Artificial Sequence
  Description of Artificial Sequence: Synthetic Peptide
VALDPIDISIELNKAKSDLEESKEWIRRSNQKLDS

SEQ ID NO: 1457 - protein, 35 aa, Artificial Sequence
  Description of Artificial Sequence: Synthetic Peptide
ALDPIDISIELNKAKSDLEESKEWIRRSNQKLDSI

SEQ ID NO: 1458 - protein, 35 aa, Artificial Sequence
  Description of Artificial Sequence: Synthetic Peptide
LDPIDISIELNKAKSDLEESKEWIRRSNQKLDSIG

SEQ ID NO: 1459 - protein, 35 aa, Artificial Sequence
  Description of Artificial Sequence: Synthetic Peptide
DPIDISIELNKAKSDLEESKEWIRRSNQKLDSIGN

SEQ ID NO: 1460 - protein, 35 aa, Artificial Sequence
  Description of Artificial Sequence: Synthetic Peptide
PIDISIELNKAKSDLEESKEWIRRSNQKLDSIGNW

SEQ ID NO: 1461 - protein, 35 aa, Artificial Sequence
  Description of Artificial Sequence: Synthetic Peptide
IDISIELNKAKSDLEESKEWIRRSNQKLDSIGNWH

SEQ ID NO: 1462 - protein, 35 aa, Artificial Sequence
  Description of Artificial Sequence: Synthetic Peptide
DISIELNKAKSDLEESKEWIRRSNQKLDSIGNWHQ

SEQ ID NO: 1463 - protein, 35 aa, Artificial Sequence
  Description of Artificial Sequence: Synthetic Peptide
ISIELNKAKSDLEESKEWIRRSNQKLDSIGNWHQS

SEQ ID NO: 1464 - protein, 35 aa, Artificial Sequence
  Description of Artificial Sequence: Synthetic Peptide
SIELNKAKSDLEESKEWIRRSNQKLDSIGNWHQSS

SEQ ID NO: 1465 - protein, 35 aa, Artificial Sequence
  Description of Artificial Sequence: Synthetic Peptide
IELNKAKSDLEESKEWIRRSNQKLDSIGNWHQSST

SEQ ID NO: 1466 - protein, 35 aa, Artificial Sequence
  Description of Artificial Sequence: Synthetic Peptide
ELNKAKSDLEESKEWIRRSNQKLDSIGNWHQSSTT

SEQ ID NO: 1467 - protein, 35 aa, Artificial Sequence
  Description of Artificial Sequence: Synthetic Peptide
TAAVALVEAKQARSDIEKLKEAIRDTNKAVQSVQS

SEQ ID NO: 1468 - protein, 35 aa, Artificial Sequence
  Description of Artificial Sequence: Synthetic Peptide
AVALVEAKQARSDIEKLKEAIRDTNKAVQSVQSSI

SEQ ID NO: 1469 - protein, 35 aa, Artificial Sequence
  Description of Artificial Sequence: Synthetic Peptide
LVEAKQARSDIEKLKEAIRDTNKAVQSVQSSIGNL

SEQ ID NO: 1470 - protein, 35 aa, Artificial Sequence
  Description of Artificial Sequence: Synthetic Peptide
VEAKQARSDIEKLKEAIRDTNKAVQSVQSSIGNLI

SEQ ID NO: 1471 - protein, 35 aa, Artificial Sequence
  Description of Artificial Sequence: Synthetic Peptide
EAKQARSDIEKLKEAIRDTNKAVQSVQSSIGNLIV

SEQ ID NO: 1472 - protein, 35 aa, Artificial Sequence
  Description of Artificial Sequence: Synthetic Peptide
AKQARSDIEKLKEAIRDTNKAVQSVQSSIGNLIVA

SEQ ID NO: 1473 - protein, 35 aa, Artificial Sequence
  Description of Artificial Sequence: Synthetic Peptide
KQARSDIEKLKEAIRDTNKAVQSVQSSIGNLIVAI

SEQ ID NO: 1474 - protein, 35 aa, Artificial Sequence
  Description of Artificial Sequence: Synthetic Peptide
QARSDIEKLKEAIRDTNKAVQSVQSSIGNLIVAIK

SEQ ID NO: 1475 - protein, 35 aa, Artificial Sequence
  Description of Artificial Sequence: Synthetic Peptide
ARSDIEKLKEAIRDTNKAVQSVQSSIGNLIVAIKS

SEQ ID NO: 1476 - protein, 35 aa, Artificial Sequence
  Description of Artificial Sequence: Synthetic Peptide
RSDIEKLKEAIRDTNKAVQSVQSSIGNLIVAIKSV

SEQ ID NO: 1477 - protein, 35 aa, Artificial Sequence
  Description of Artificial Sequence: Synthetic Peptide
SDIEKLKEAIRDTNKAVQSVQSSIGNLIVAIKSVQ

SEQ ID NO: 1478 - protein, 35 aa, Artificial Sequence
  Description of Artificial Sequence: Synthetic Peptide
KLKEAIRDTNKAVQSVQSSIGNLIVAIKSVQDYVN

SEQ ID NO: 1479 - protein, 35 aa, Artificial Sequence
  Description of Artificial Sequence: Synthetic Peptide
LKEAIRDTNKAVQSVQSSIGNLIVAIKSVQDYVNK

SEQ ID NO: 1480 - protein, 35 aa, Artificial Sequence
  Description of Artificial Sequence: Synthetic Peptide
AIRDTNKAVQSVQSSIGNLIVAIKSVQDYVNKEIV

SEQ ID NO: 1481 - protein, 47 aa, Artificial Sequence
  Description of Artificial Sequence: Synthetic Peptide
TWQEWERKVDFLEENITALLEEAQIQQEKNMYELQKLNSWDVFGNWF

SEQ ID NO: 1482 - protein, 35 aa, Artificial Sequence
  Description of Artificial Sequence: Synthetic Peptide
WQEWERKVDFLEENITALLEEAQIQQEKNMYELQK

SEQ ID NO: 1483 - protein, 35 aa, Artificial Sequence
  Description of Artificial Sequence: Synthetic Peptide
QEWERKVDFLEENITALLEEAQIQQEKNMYELQKL

SEQ ID NO: 1484 - protein, 35 aa, Artificial Sequence
  Description of Artificial Sequence: Synthetic Peptide
EWERKVDFLEENITALLEEAQIQQEKNMYELQKLN

SEQ ID NO: 1485 - protein, 35 aa, Artificial Sequence
  Description of Artificial Sequence: Synthetic Peptide
WERKVDFLEENITALLEEAQIQQEKNMYELQKLNS

SEQ ID NO: 1486 - protein, 35 aa, Artificial Sequence
  Description of Artificial Sequence: Synthetic Peptide
ERKVDFLEENITALLEEAQIQQEKNMYELQKLNSW

SEQ ID NO: 1487 - protein, 35 aa, Artificial Sequence
  Description of Artificial Sequence: Synthetic Peptide
RKVDFLEENITALLEEAQIQQEKNMYELQKLNSWD

SEQ ID NO: 1488 - protein, 35 aa, Artificial Sequence
  Description of Artificial Sequence: Synthetic Peptide
KVDFLEENITALLEEAQIQQEKNMYELQKLNSWDV

SEQ ID NO: 1489 - protein, 35 aa, Artificial Sequence
  Description of Artificial Sequence: Synthetic Peptide
VDFLEENITALLEEAQIQQEKNMYELQKLNSWDVF

SEQ ID NO: 1490 - protein, 35 aa, Artificial Sequence
  Description of Artificial Sequence: Synthetic Peptide
DFLEENITALLEEAQIQQEKNMYELQKLNSWDVFG

SEQ ID NO: 1491 - protein, 35 aa, Artificial Sequence
  Description of Artificial Sequence: Synthetic Peptide
FLEENITALLEEAQIQQEKNMYELQKLNSWDVFGN

SEQ ID NO: 1492 - protein, 35 aa, Artificial Sequence
  Description of Artificial Sequence: Synthetic Peptide
PDAVYLHRIDLGPPISLERLDVGTNLGNAIAKLED

SEQ ID NO: 1493 - protein, 34 aa, Artificial Sequence
  Description of Artificial Sequence: Synthetic Peptide
LERLDVGTNLGNAIAKLEAKELLESSDQILRSMK

SEQ ID NO: 1494 - protein, 34 aa, Artificial Sequence
  Description of Artificial Sequence: Synthetic Peptide
LHRIDLGPPISLERLDVGTNLGNAIAKLEAKELL

SEQ ID NO: 1495 - protein, 34 aa, Artificial Sequence
  Description of Artificial Sequence: Synthetic Peptide
HRIDLGPPISLERLDVGTNLGNAIAKLEAKELLE

SEQ ID NO: 1496 - protein, 34 aa, Artificial Sequence
  Description of Artificial Sequence: Synthetic Peptide
RIDLGPPISLERLDVGTNLGNAIAKLEAKELLES

SEQ ID NO: 1497 - protein, 34 aa, Artificial Sequence
  Description of Artificial Sequence: Synthetic Peptide
IDLGPPISLERLDVGTNLGNAIAKLEAKELLESS

SEQ ID NO: 1498 - protein, 34 aa, Artificial Sequence
  Description of Artificial Sequence: Synthetic Peptide
DLGPPISLERLDVGTNLGNAIAKLEAKELLESSD

SEQ ID NO: 1499 - protein, 34 aa, Artificial Sequence
  Description of Artificial Sequence: Synthetic Peptide
LGPPISLERLDVGTNLGNAIAKLEAKELLESSDQ

SEQ ID NO: 1500 - protein, 34 aa, Artificial Sequence
  Description of Artificial Sequence: Synthetic Peptide
GPPISLERLDVGTNLGNAIAKLEAKELLESSDQI

SEQ ID NO: 1501 - protein, 34 aa, Artificial Sequence
  Description of Artificial Sequence: Synthetic Peptide
PPISLERLDVGTNLGNAIAKLEAKELLESSDQIL

SEQ ID NO: 1502 - protein, 34 aa, Artificial Sequence
  Description of Artificial Sequence: Synthetic Peptide
PISLERLDVGTNLGNAIAKLEAKELLESSDQILR

SEQ ID NO: 1503 - protein, 34 aa, Artificial Sequence
  Description of Artificial Sequence: Synthetic Peptide
SLERLDVGTNLGNAIAKLEAKELLESSDQILRSM

SEQ ID NO: 1504 - protein, 34 aa, Artificial Sequence; identical to SEQ ID NO: 1493
  Description of Artificial Sequence: Synthetic Peptide

SEQ ID NO: 1505 - protein, 22 aa, Artificial Sequence
  Description of Artificial Sequence: Synthetic Peptide
YLCEFCLKYGRSLKCLQRHLTK

SEQ ID NO: 1506 - protein, 8 aa, Artificial Sequence
  Description of Artificial Sequence: Synthetic Peptide
ASTTTNYT

SEQ ID NO: 1507 - protein, 8 aa, Artificial Sequence
  Description of Artificial Sequence: Synthetic Peptide
ASTTTNYT

SEQ ID NO: 1508 - protein, 8 aa, Artificial Sequence
  Description of Artificial Sequence: Synthetic Peptide
SQNYPIVQ

SEQ ID NO: 1509 - protein, 6 aa, Artificial Sequence
  Description of Artificial Sequence: Synthetic Peptide
ELDKWA

SEQ ID NO: 1510 - protein, 11 aa, Artificial Sequence
  Description of Artificial Sequence: Synthetic Peptide
RGVVNASSRLA

SEQ ID NO: 1511 - protein, 10 aa, Artificial Sequence
  Description of Artificial Sequence: Synthetic Peptide
RGRRQPIPKA

SEQ ID NO: 1512 - protein, 23 aa, Artificial Sequence
  Description of Artificial Sequence: Synthetic Peptide
LTTGSVVIVGRIILSGRPAVVPD

SEQ ID NO: 1513 - protein, 14 aa, Artificial Sequence
  Description of Artificial Sequence: Synthetic Peptide
GSVVIVGRIILSGR

SEQ ID NO: 1514 - protein, 27 aa, Artificial Sequence
  Description of Artificial Sequence: Synthetic Peptide
PLGFFPDHQLDPAFGANSNNPDWDFNP

SEQ ID NO: 1515 - protein, 26 aa, Artificial Sequence
  Description of Artificial Sequence: Synthetic Peptide
MQWNSTTFHQTLQDPRVRGLYFPAGG

SEQ ID NO: 1516 - protein, 11 aa, Artificial Sequence
  Description of Artificial Sequence: Synthetic Peptide
MQWNSTAFHQT

SEQ ID NO: 1517 - protein, 8 aa, Artificial Sequence
  Description of Artificial Sequence: Synthetic Peptide
YGAVVNDL

SEQ ID NO: 1518 - protein, 21 aa, Artificial Sequence
  Description of Artificial Sequence: Synthetic Peptide
CTHGIRPVVSTQLLLNGSLAE

SEQ ID NO: 1519 - protein, 7 aa, Artificial Sequence
  Description of Artificial Sequence: Synthetic Peptide
SENYPIV

SEQ ID NO: 1520 - protein, 7 aa, Artificial Sequence
  Description of Artificial Sequence: Synthetic Peptide
KARVFEA

SEQ ID NO: 1521 - protein, 15 aa, Artificial Sequence
  Description of Artificial Sequence: Synthetic Peptide
RIQRGPGRAFVTIGK

SEQ ID NO: 1522 - protein, 8 aa, Artificial Sequence
  Description of Artificial Sequence: Synthetic Peptide
ASTTTNYT

SEQ ID NO: 1523 - protein, 8 aa, Artificial Sequence
  Description of Artificial Sequence: Synthetic Peptide
ASTTTNYT

SEQ ID NO: 1524 - protein, 15 aa, Artificial Sequence
  Description of Artificial Sequence: Synthetic Peptide
RIQRGPGRAFVTIGK

SEQ ID NO: 1525 - protein, 38 aa, Artificial Sequence
  Description of Artificial Sequence: Synthetic Peptide
NNLLRAIEAQQHLLQLTVWGIKQLQARILAVERYLKDQ

SEQ ID NO: 1526 - protein, 10 aa, Artificial Sequence
  Description of Artificial Sequence: Synthetic Peptide
RGPGRAFVTI

SEQ ID NO: 1527 - protein, 3 aa, Artificial Sequence
  Description of Artificial Sequence: Synthetic Peptide
FFG

SEQ ID NO: 1528 - protein, 36 aa, Artificial Sequence; identical to SEQ ID NO: 1419
  Description of Artificial Sequence: Synthetic Peptide

SEQ ID NO: 1529 - protein, 2 aa, Artificial Sequence
  Description of Artificial Sequence: Synthetic Peptide
TQ

SEQ ID NO: 1530 - protein, 6 aa, Artificial Sequence
  Description of Artificial Sequence: Synthetic Peptide
WHWLQL

SEQ ID NO: 1531 - protein, 5 aa, Artificial Sequence
  Description of Artificial Sequence: Synthetic Peptide
GPGAG

SEQ ID NO: 1532 - protein, 2 aa, Artificial Sequence
  Description of Artificial Sequence: Synthetic Peptide
HG

SEQ ID NO: 1533 - protein, 5 aa, Artificial Sequence
  Description of Artificial Sequence: Synthetic Peptide
FVFLM

SEQ ID NO: 1534 - protein, 3 aa, Artificial Sequence
  Description of Artificial Sequence: Synthetic Peptide
TSK

SEQ ID NO: 1535 - protein, 3 aa, Artificial Sequence
  Description of Artificial Sequence: Synthetic Peptide
KHG

SEQ ID NO: 1536 - protein, 16 aa, Artificial Sequence
  Description of Artificial Sequence: Synthetic Peptide
KNRWEDPGKQLYNVEA

SEQ ID NO: 1537 - protein, 10 aa, Artificial Sequence
  Description of Artificial Sequence: Synthetic Peptide
LRAHAVDVNG

SEQ ID NO: 1538 - protein, 14 aa, Artificial Sequence
  Description of Artificial Sequence: Synthetic Peptide
WSKMDQLAKELTAE

SEQ ID NO: 1539 - protein, 4 aa, Artificial Sequence
  Description of Artificial Sequence: Synthetic Peptide
TPRK

SEQ ID NO: 1540 - protein, 12 aa, Artificial Sequence
  Description of Artificial Sequence: Synthetic Peptide
GELQNQLIRKSN

SEQ ID NO: 1541 - protein, 17 aa, Artificial Sequence
  Description of Artificial Sequence: Synthetic Peptide
GEYQKMLNLRAEVKKNA

SEQ ID NO: 1542 - protein, 9 aa, Artificial Sequence
  Description of Artificial Sequence: Synthetic Peptide
PFCNAFTGC

SEQ ID NO: 1543 - protein, 8 aa, Artificial Sequence
  Description of Artificial Sequence: Synthetic Peptide
EKAHDGGR

SEQ ID NO: 1544 - protein, 14 aa, Artificial Sequence
  Description of Artificial Sequence: Synthetic Peptide
PFTRNYYVRAVLHL

SEQ ID NO: 1545 - protein, 39 aa, Artificial Sequence
  Description of Artificial Sequence: Synthetic Peptide
APRLPQCQGDDQEKCLCNKDECPPGQCRFPRGDADPYCE

SEQ ID NO: 1546 - protein, 8 aa, Artificial Sequence
  Description of Artificial Sequence: Synthetic Peptide
KGDEESLA

SEQ ID NO: 1547 - protein, 9 aa, Artificial Sequence
  Description of Artificial Sequence: Synthetic Peptide
WAGGDASGE

SEQ ID NO: 1548 - protein, 20 aa, Artificial Sequence
  Description of Artificial Sequence: Synthetic Peptide
QATVGDVNTDRPGLLDLKYY

SEQ ID NO: 1549 - protein, 17 aa, Artificial Sequence
  Description of Artificial Sequence: Synthetic Peptide
TKRRAIGFKKLAEAVKC

SEQ ID NO: 1550 - protein, 8 aa, Artificial Sequence
  Description of Artificial Sequence: Synthetic Peptide
SIINFEKL

SEQ ID NO: 1551 - protein, 6 aa, Artificial Sequence
  Description of Artificial Sequence: Synthetic Peptide
FQVVCG

SEQ ID NO: 1552 - protein, 6 aa, Artificial Sequence
  Description of Artificial Sequence: Synthetic Peptide
ARMAPE

SEQ ID NO: 1553 - protein, 4 aa, Artificial Sequence
  Description of Artificial Sequence: Synthetic Peptide
GQPR

SEQ ID NO: 1554 - protein, 3 aa, Artificial Sequence
  Description of Artificial Sequence: Synthetic Peptide
TVL

SEQ ID NO: 1555 - protein, 49 aa, Artificial Sequence
  Description of Artificial Sequence: Synthetic Peptide
LLSKRGHCPRILFRCPLSNPSNKCWRDYDCPGVKKCCEGFCGKDCLYPK

SEQ ID NO: 1556 - protein, 10 aa, Artificial Sequence
  Description of Artificial Sequence: Synthetic Peptide
GFDLNGGGVG

SEQ ID NO: 1557 - protein, 18 aa, Artificial Sequence
  Description of Artificial Sequence: Synthetic Peptide
AVQSKPPSKRDPPKMQTD

SEQ ID NO: 1558 - protein, 4 aa, Artificial Sequence
  Description of Artificial Sequence: Synthetic Peptide
TKPR

SEQ ID NO: 1559 - protein, 11 aa, Artificial Sequence
  Description of Artificial Sequence: Synthetic Peptide
YLNFTPNWGTY

SEQ ID NO: 1560 - protein, 5 aa, Artificial Sequence
  Description of Artificial Sequence: Synthetic Peptide
DLWQK

SEQ ID NO: 1561 - protein, 17 aa, Artificial Sequence
  Description of Artificial Sequence: Synthetic Peptide
WYEPIYLGGVFQLEKGD

SEQ ID NO: 1562 - protein, 39 aa, Artificial Sequence
  Description of Artificial Sequence: Synthetic Peptide
APRLPQCQGDQEKCLCNKDECPPGQCRFPRGDADPYCED

SEQ ID NO: 1563 - protein, 4 aa, Artificial Sequence
  Description of Artificial Sequence: Synthetic Peptide
TKPR

SEQ ID NO: 1564 - protein, 6 aa, Artificial Sequence
  Description of Artificial Sequence: Synthetic Peptide
EEVVAC

SEQ ID NO: 1565 - protein, 4 aa, Artificial Sequence
  Description of Artificial Sequence: Synthetic Peptide
SDKP

SEQ ID NO: 1566 - protein, 6 aa, Artificial Sequence
  Description of Artificial Sequence: Synthetic Peptide
RFWINK

SEQ ID NO: 1567 - protein, 13 aa, Artificial Sequence
  Description of Artificial Sequence: Synthetic Peptide
CGYGPKKKRKVGG

SEQ ID NO: 1568 - protein, 1 aa, Artificial Sequence
  Description of Artificial Sequence: Synthetic Peptide
L

SEQ ID NO: 1569 - protein, 5 aa, Artificial Sequence
  Description of Artificial Sequence: Synthetic Peptide
DDDDD

SEQ ID NO: 1570 - protein, 6 aa, Artificial Sequence
  Description of Artificial Sequence: Synthetic Peptide
DDDDDD

SEQ ID NO: 1571 - protein, 8 aa, Artificial Sequence
  Description of Artificial Sequence: Synthetic Peptide
NPNANPNA

SEQ ID NO: 1572 - protein, 8 aa, Artificial Sequence
  Description of Artificial Sequence: Synthetic Peptide
VAITVLVK

SEQ ID NO: 1573 - protein, 6 aa, Artificial Sequence
  Description of Artificial Sequence: Synthetic Peptide
VGVRVR

SEQ ID NO: 1574 - protein, 4 aa, Artificial Sequence
  Description of Artificial Sequence: Synthetic Peptide
VIHS

SEQ ID NO: 1575 - protein, 5 aa, Artificial Sequence
  Description of Artificial Sequence: Synthetic Peptide
VPDPR

SEQ ID NO: 1576 - protein, 4 aa, Artificial Sequence
  Description of Artificial Sequence: Synthetic Peptide
VTCG

SEQ ID NO: 1577 - protein, 3 aa, Artificial Sequence
  Description of Artificial Sequence: Synthetic Peptide
RSR

SEQ ID NO: 1578 - protein, 11 aa, Artificial Sequence
  Description of Artificial Sequence: Synthetic Peptide
SAKLCPGGNCV

SEQ ID NO: 1579 - protein, 6 aa, Artificial Sequence
  Description of Artificial Sequence: Synthetic Peptide
DHARWK

SEQ ID NO: 1580 - protein, 7 aa, Artificial Sequence
  Description of Artificial Sequence: Synthetic Peptide
PQDPQDL

SEQ ID NO: 1581 - protein, 6 aa, Artificial Sequence
  Description of Artificial Sequence: Synthetic Peptide
QHFRWG

SEQ ID NO: 1582 - protein, 19 aa, Artificial Sequence
  Description of Artificial Sequence: Synthetic Peptide
NQEQVSPLTLLKLGNQEPG

SEQ ID NO: 1583 - protein, 20 aa, Artificial Sequence
  Description of Artificial Sequence: Synthetic Peptide
LSALSLDEPFIQKDVELRIM

SEQ ID NO: 1584 - protein, 15 aa, Artificial Sequence
  Description of Artificial Sequence: Synthetic Peptide
APEAQVSVQPNFQQD

SEQ ID NO: 1585 - protein, 27 aa, Artificial Sequence
  Description of Artificial Sequence: Synthetic Peptide
EYGGTKVLDDKDYFLFRDGDILGKYVD

SEQ ID NO: 1586 - protein, 16 aa, Artificial Sequence
  Description of Artificial Sequence: Synthetic Peptide
KAYINKVEELKKKYGI

SEQ ID NO: 1587 - protein, 24 aa, Artificial Sequence
  Description of Artificial Sequence: Synthetic Peptide
SQQSSSYGQQSEKPYQCDFKDCER

SEQ ID NO: 1588 - protein, 15 aa, Artificial Sequence
  Description of Artificial Sequence: Synthetic Peptide
ATESIAYLAPPYAFR

SEQ ID NO: 1589 - protein, 16 aa, Artificial Sequence [sequence omitted]

SEQ ID NO: 1590 - protein, 13 aa, Artificial Sequence
  Description of Artificial Sequence: Synthetic Peptide
VSHPYSQHLEGKG

SEQ ID NO: 1591 - protein, 7 aa, Artificial Sequence
  Description of Artificial Sequence: Synthetic Peptide
ALTDFFR

SEQ ID NO: 1592 - protein, 20 aa, Artificial Sequence
  Description of Artificial Sequence: Synthetic Peptide
QAIGLMGYRLSPQTLTTIVK

SEQ ID NO: 1593 - protein, 17 aa, Artificial Sequence
  Description of Artificial Sequence: Synthetic Peptide
MGFNAFKELWAALNAWK

SEQ ID NO: 1594 - protein, 16 aa, Artificial Sequence [sequence omitted]

SEQ ID NO: 1595 - protein, 17 aa, Artificial Sequence
  Description of Artificial Sequence: Synthetic Peptide
ELDAKIPSTGDATEWRN

SEQ ID NO: 1596 - protein, 20 aa, Artificial Sequence
  Description of Artificial Sequence: Synthetic Peptide
PDTRPAPGSTAPPAHGVTSA

SEQ ID NO: 1597 - protein, 20 aa, Artificial Sequence
  Description of Artificial Sequence: Synthetic Peptide
GKEILVGDVGQTVDDPYATF

SEQ ID NO: 1598 - protein, 15 aa, Artificial Sequence
  Description of Artificial Sequence: Synthetic Peptide
ELSLAGNELGDEGAR

SEQ ID NO: 1599 - protein, 22 aa, Artificial Sequence
  Description of Artificial Sequence: Synthetic Peptide
MFIVNTNVPRASVPDGFLSELT

SEQ ID NO: 1600 - protein, 35 aa, Artificial Sequence [sequence omitted]

SEQ ID NO: 1601 - protein, 27 aa, Artificial Sequence
  Description of Artificial Sequence: Synthetic Peptide
GLPGRDGRDGREGFRGEEGDPGLPGAA

SEQ ID NO: 1602 - protein, 21 aa, Artificial Sequence
  Description of Artificial Sequence: Synthetic Peptide
CKTCQRKFSRSGHLKTHTRTH

SEQ ID NO: 1603 - protein, 15 aa, Artificial Sequence
  Description of Artificial Sequence: Synthetic Peptide
HVSSEAFRMCDVCLE

SEQ ID NO: 1604 - protein, 5 aa, Artificial Sequence
  Description of Artificial Sequence: Synthetic Peptide
PHSRN

SEQ ID NO: 1605 - protein, 5 aa, Artificial Sequence
  Description of Artificial Sequence: Synthetic Peptide
PHSCN

SEQ ID NO: 1606 - protein, 28 aa, Artificial Sequence
  Description of Artificial Sequence: Synthetic Peptide
MGPGAPFARVGWPLPLLVVMAGVAPVWA

SEQ ID NO: 1607 - protein, 15 aa, Artificial Sequence
  Description of Artificial Sequence: Synthetic Peptide
MVKSHIGSWILVLFV

SEQ ID NO: 1608 - protein, 9 aa, Artificial Sequence
  Description of Artificial Sequence: Synthetic Peptide
CSLPGSAAA

SEQ ID NO: 1609 - protein, 15 aa, Artificial Sequence
  Description of Artificial Sequence: Synthetic Peptide
RGLKRQSDERKRDRE

SEQ ID NO: 1610 - protein, 57 aa, Artificial Sequence
  Description of Artificial Sequence: Synthetic Peptide
GRSHMVLNSALEGARGGPGGEEIPERFSIPELQWMLSNAELAPVQADEPPQSRMDLV

SEQ ID NO: 1611 - protein, 35 aa, Artificial Sequence
  Description of Artificial Sequence: Synthetic Peptide
QARAVGLAGTSRAFLSSRLQDLYSIVRRADRAAVM

SEQ ID NO: 1612 - protein, 15 aa, Artificial Sequence
  Description of Artificial Sequence: Synthetic Peptide
MVKSHIGSWILVLFV

SEQ ID NO: 1613 - protein, 29 aa, Artificial Sequence
  Description of Artificial Sequence: Synthetic Peptide
LRDLVSYCRARGKGRERMNGTRKGHLLYM

SEQ ID NO: 1614 - protein, 33 aa, Artificial Sequence
  Description of Artificial Sequence: Synthetic Peptide
GKRSSPETLISDLLMRESTENVPRTRLEDPAMW

SEQ ID NO: 1615 - protein, 30 aa, Artificial Sequence
  Description of Artificial Sequence: Synthetic Peptide
DVEPLLGFLSPKSGQENEVDDFPYKGQGEL

SEQ ID NO: 1616 - protein, 20 aa, Artificial Sequence
  Description of Artificial Sequence: Synthetic Peptide
FCKCRLEPMKATCDISECPE

SEQ ID NO: 1617 - protein, 20 aa, Artificial Sequence
  Description of Artificial Sequence: Synthetic Peptide
KSHGRTQNPVVHFFKNIVTP

We claim:

1. A method of synthesizing a modified therapeutic peptide capable of forming a peptidase-stabilized therapeutic peptide conjugate, the peptide comprising between 3 and 50 amino acids and having a carboxy terminal amino acid, an amino terminal amino acid, the method of comprising the steps of:
   a) synthesizing the peptide from the carboxy terminal amino acid or the amino terminal amino acid,
   b) sequentially and selectively oxidizing any pairs of cysteine residues in said therapeutic peptide to form disulfide bridges in said therapeutic peptide;
   c) attaching a protecting group to any remaining cysteine residues that do not form said disulfide bridges in said therapeutic peptide; and
   d) coupling a reactive group to the carboxy terminal amino acid, to the amino terminal amino acid, or to an amino acid between the carboxy terminal amino acid and the amino terminal amino acid, wherein the reactive group is capable of reacting with an amino group, an hydroxyl group or a thiol group on blood component to form a covalent bond therewith.

2. A method as claimed in claim 1 wherein the reactive group is selected from the group consisting of succinimidyl- and maleimido-containing groups.

3. A method as claimed in claim 2 wherein the reactive entity is a maleimido-containing group.

4. A method as claimed in claim 1, further comprising bonding a lysine residue to said peptide, wherein the reactive group is coupled to the peptide via said lysine residue.

5. A method as claimed in claim 1 wherein the reactive group is coupled to the carboxy terminal amino acid of the peptide.

6. A method as claimed in claim 1 wherein the peptide does not contain a cysteine.

7. A method as claimed in claim 1 wherein the therapeutic peptide contains two cysteines, the two cysteines are oxidized to form a disulfide bridge, and the reactive group is coupled to the peptide.

8. A method as claimed in claim 6 wherein the peptide is synthesized from the carboxy terminal amino acid.

9. A method of synthesizing a modified therapeutic peptide and forming a peptidase-stabilized therapeutic peptide conjugate, the peptide comprising between 3 and 50 amino acids and having a carboxy terminal amino acid and an amino terminal amino acid, the method comprising the steps of synthesizing the peptide from the carboxy terminal amino acid, coupling a maleimido-containing group, to the carboxy terminal amino acid, the amino terminal amino acid, an amino acid between the carboxy terminal amino acid and the amino terminal amino acid, and reacting the maleimido-containing group with a thiol group on a blood component to form a covalent bond therewith.

10. A method as claimed in claim 9 wherein the maleimido-containing group is coupled to the carboxy terminal amino acid.

11. A method as claimed in claim 9, further comprising bonding a lysine residue to said peptide, wherein the maleimido-containing group is coupled to the peptide via said lysine residue.

12. A method as claimed in claim 9 wherein said reacting step occurs in vivo.

13. A method as claimed in claim 9 wherein said reacting step occurs ex vivo.

* * * * *

UNITED STATES PATENT AND TRADEMARK OFFICE
CERTIFICATE OF CORRECTION

PATENT NO. : 6,849,714 B1
DATED : February 1, 2005
INVENTOR(S) : Dominique P. Bridon et al.

It is certified that error appears in the above-identified patent and that said Letters Patent is hereby corrected as shown below:

Title page,
Item [57], ABSTRACT,
Line 4, please replace "k" with -- described --.

Column 14,
Line 47, please replace "3761" with -- 376 --.

Column 18,
Line 32, please replace "A conjugated would be" with -- A conjugated BNP would be --.

Column 28,
Line 56, please replace "1281" with -- 1288 --.

Signed and Sealed this

Twenty-third Day of August, 2005

JON W. DUDAS
*Director of the United States Patent and Trademark Office*